US011634723B2

(12) United States Patent
Cook et al.

(10) Patent No.: US 11,634,723 B2
(45) Date of Patent: Apr. 25, 2023

(54) PROMOTER, PROMOTER CONTROL ELEMENTS, AND COMBINATIONS, AND USES THEREOF

(71) Applicant: Ceres, Inc., Thousand Oaks, CA (US)

(72) Inventors: Zhihong Cook, Aliso Viejo, CA (US); Yiwen Fang, Redondo Beach, CA (US); Kenneth A. Feldmann, Tucson, AZ (US); Edward Kiegle, Schoharie, NY (US); Shing Kwok, Fairfax, VA (US); Yu-Ping Lu, Arcadia, CA (US); Leonard Medrano, Azusa, CA (US); Roger Pennell, Malibu, CA (US); Richard Schneeberger, Carlsbad, CA (US); Chuan-Yin Wu, Newbury-Park, CA (US); Nestor Apuya, Culver City, CA (US); Jack K. Okamuro, Santa Cruz, CA (US); Diane K. Jofuku, Alexandria, VA (US); Jonathan Donson, Oak Park, CA (US); David Van-Dinh Dang, San Diego, CA (US); Emilio Margolles-Clark, Miami, FL (US); Nickolai Alexandrov, Thousand Oaks, CA (US); Tatiana Tatarinova, Los Angeles, CA (US); Noah Theiss, Tucson, AZ (US); Danielle Grizard, Moorpark, CA (US); Shawna Davis, Kalaheo, HI (US); Dennis Robles, Chatsworth, CA (US); Michael Portereiko, Thousand Oaks, CA (US)

(73) Assignee: Ceres, Inc., Thousand Oaks, CA (US)

( * ) Notice: Subject to any disclaimer, the term of this patent is extended or adjusted under 35 U.S.C. 154(b) by 367 days.

(21) Appl. No.: 16/938,557

(22) Filed: Jul. 24, 2020

(65) Prior Publication Data
US 2021/0062205 A1 Mar. 4, 2021

Related U.S. Application Data

(60) Division of application No. 15/967,437, filed on Apr. 30, 2018, now Pat. No. 10,851,383, which is a continuation of application No. 13/664,313, filed on Oct. 30, 2012, now abandoned, which is a continuation-in-part of application No. 13/550,341, filed on Jul. 16, 2012, now abandoned, which is a continuation-in-part of application No. 12/865,719, filed as application No. PCT/US2009/032485 on Jan. 29, 2009, now abandoned, said application No. 15/967,437 is a continuation-in-part of application No. 13/550,341, filed on Jul. 16, 2012, now abandoned, which is a continuation-in-part of application No. 12/891,723, filed on Sep. 27, 2010, now abandoned, which is a division of application No. 11/600,953, filed on Nov. 14, 2006, now Pat. No. 7,851,608, which is a division of application No. 10/957,569, filed on Sep. 30, 2004, now Pat. No. 7,402,667, which is a continuation-in-part of application No. 10/950,321, filed on Sep. 23, 2004, now Pat. No. 7,173,121, said application No. 13/550,341 is a continuation-in-part of application No. 12/504,863, filed on Jul. 17, 2009, now Pat. No. 8,278,434, which is a continuation of application No. 11/598,118, filed on Nov. 10, 2006, now abandoned, which is a division of application No. 10/950,321, filed on Sep. 23, 2004, now Pat. No. 7,173,121, said application No. 13/550,341 is a continuation-in-part of application No. 10/965,470, filed on Oct. 13, 2004, now Pat. No. 7,169,915, said application No. 13/550,341 is a continuation-in-part of application No. 12/103,970, filed on Apr. 16, 2008, now Pat. No. 8,389,805, which is a division of application No.
(Continued)

(51) Int. Cl.
C12N 15/82 (2006.01)

(52) U.S. Cl.
CPC ....... C12N 15/8222 (2013.01); C12N 15/823 (2013.01); C12N 15/8226 (2013.01); C12N 15/8227 (2013.01)

(58) Field of Classification Search
None
See application file for complete search history.

(56) References Cited

U.S. PATENT DOCUMENTS

| | | | |
|---|---|---|---|
| 5,362,865 A | 11/1994 | Austin | |
| 5,424,412 A | 6/1995 | Brown et al. | |

(Continued)

FOREIGN PATENT DOCUMENTS

| | | | |
|---|---|---|---|
| EP | 1033405 A2 | 9/2000 | |
| EP | 1209228 | 5/2002 | |

(Continued)

OTHER PUBLICATIONS

Donald & Cashmore (1990) EMBO J 9:1717-26.*
(Continued)

Primary Examiner — Russell T Boggs
(74) Attorney, Agent, or Firm — Dentons US LLP

(57) ABSTRACT

The present invention is directed to promoter sequences and promoter control elements, polynucleotide constructs comprising the promoters and control elements, and methods of identifying the promoters, control elements, or fragments thereof. The invention further relates to the use of the present promoters or promoter control elements to modulate transcript levels.

Figure 1:
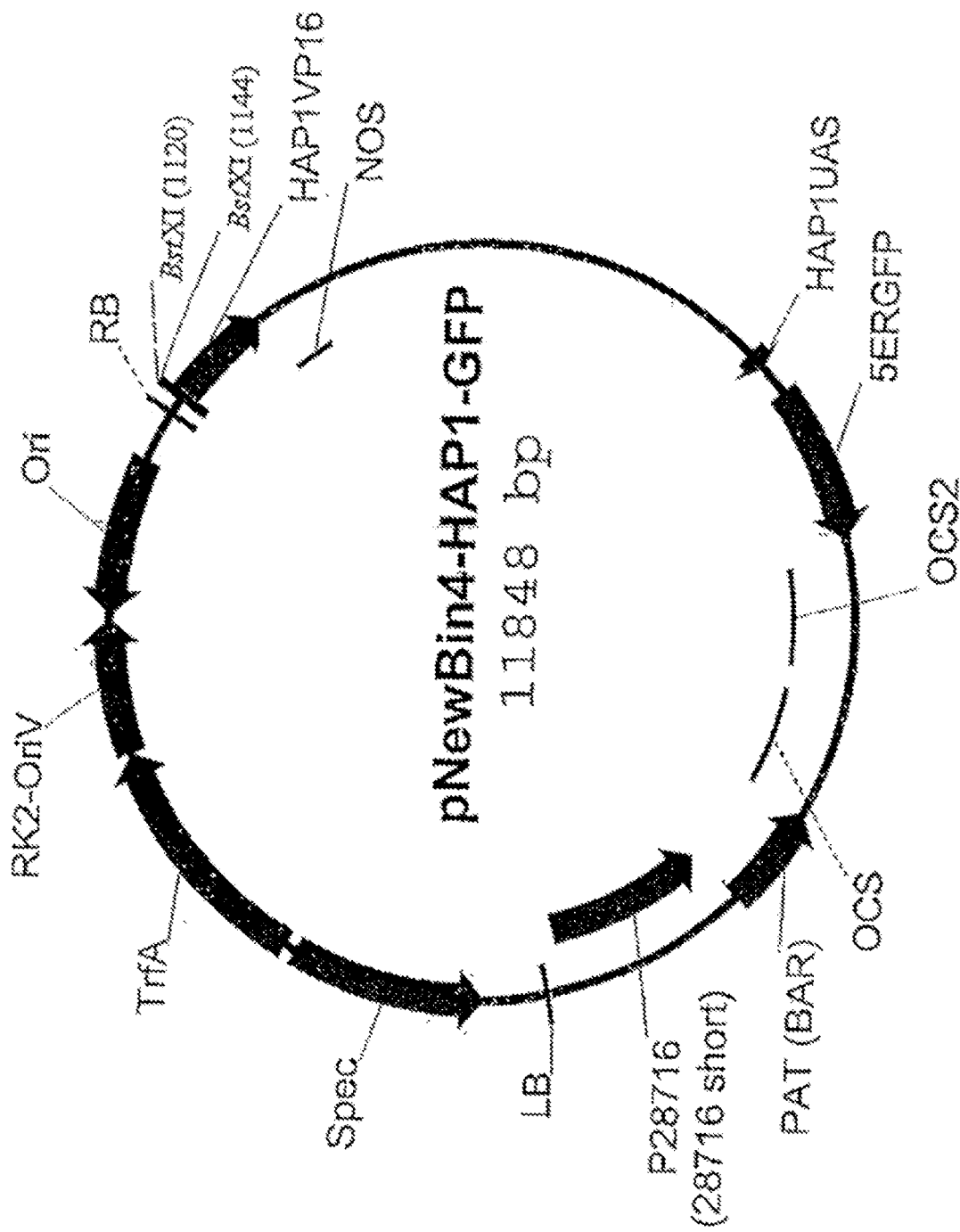

12 Claims, 3 Drawing Sheets
Specification includes a Sequence Listing.

Related U.S. Application Data

11/233,726, filed on Sep. 23, 2005, now Pat. No. 7,378,571, said application No. 13/550,341 is a continuation-in-part of application No. 12/343,190, filed on Dec. 23, 2008, now abandoned, which is a division of application No. 11/603,542, filed on Nov. 22, 2006, now Pat. No. 7,868,155, which is a division of application No. 10/981,334, filed on Nov. 4, 2004, now Pat. No. 7,179,904, said application No. 13/550,341 is a continuation-in-part of application No. 12/502,117, filed on Jul. 13, 2009, now abandoned, which is a continuation of application No. 12/123,699, filed on May 20, 2008, now abandoned, which is a division of application No. 11/305,589, filed on Dec. 16, 2005, now Pat. No. 7,385,105, said application No. 13/550,341 is a continuation-in-part of application No. 12/575,402, filed on Oct. 7, 2009, now abandoned, which is a continuation of application No. 11/097,589, filed on Apr. 1, 2005, now abandoned, said application No. 13/550,341 is a continuation-in-part of application No. 12/698,056, filed on Feb. 1, 2010, now abandoned, which is a continuation of application No. 12/294,418, filed as application No. PCT/US2007/064848 on Mar. 23, 2007, now abandoned, said application No. 13/550,341 is a continuation-in-part of application No. 12/891,689, filed on Sep. 27, 2010, now abandoned, which is a division of application No. 11/602,163, filed on Nov. 20, 2006, now Pat. No. 7,838,650, which is a division of application No. 11/172,703, filed on Jun. 30, 2005, now Pat. No. 7,214,789.

(60) Provisional application No. 61/025,697, filed on Feb. 1, 2008, provisional application No. 60/505,689, filed on Sep. 23, 2003, provisional application No. 60/529,352, filed on Dec. 12, 2003, provisional application No. 60/544,771, filed on Feb. 13, 2004, provisional application No. 60/511,460, filed on Oct. 14, 2003, provisional application No. 60/637,174, filed on Dec. 16, 2004, provisional application No. 60/612,891, filed on Sep. 23, 2004, provisional application No. 60/613,134, filed on Sep. 23, 2004, provisional application No. 60/518,075, filed on Nov. 6, 2003, provisional application No. 60/527,611, filed on Dec. 4, 2003, provisional application No. 60/637,140, filed on Dec. 16, 2004, provisional application No. 60/558,869, filed on Apr. 1, 2004, provisional application No. 60/785,794, filed on Mar. 24, 2006, provisional application No. 60/583,691, filed on Jun. 30, 2004, provisional application No. 60/583,609, filed on Jun. 30, 2004.

(56) References Cited

U.S. PATENT DOCUMENTS

| | | | |
|---|---|---|---|
| 5,459,252 A | 10/1995 | Conkling et al. | |
| 5,659,122 A | 8/1997 | Austin | |
| 5,754,888 A | 5/1998 | Yang et al. | |
| 5,764,903 A | 6/1998 | Yu | |
| 5,837,848 A | 11/1998 | Ely et al. | |
| 5,857,208 A | 1/1999 | Ofek | |
| 5,974,563 A | 10/1999 | Beeler, Jr. | |
| 6,092,066 A | 7/2000 | Ofek | |
| 6,177,611 B1 | 1/2001 | Rice | |
| 6,448,476 B1 | 9/2002 | Barry | |
| 7,173,121 B2 * | 2/2007 | Fang | C12N 15/8216 435/320.1 |
| 7,179,904 B2 * | 2/2007 | Kwok | C12N 15/8216 435/320.1 |
| 7,196,247 B2 | 3/2007 | Odell et al. | |
| 7,259,296 B2 | 8/2007 | Schmulling et al. | |
| 7,378,571 B2 | 5/2008 | Apuya et al. | |
| 7,402,667 B2 * | 7/2008 | Cook | C12N 15/8216 435/320.1 |
| 7,851,608 B2 | 12/2010 | Cook et al. | |
| 10,851,383 B2 | 12/2020 | Cook et al. | |
| 2003/0226166 A1 | 12/2003 | Falco et al. | |
| 2005/0048556 A1 | 3/2005 | Heck et al. | |
| 2005/0086718 A1 | 4/2005 | Heard et al. | |
| 2005/0204429 A1 | 9/2005 | Penell et al. | |
| 2005/0246785 A1 | 11/2005 | Cook et al. | |
| 2006/0008816 A1 | 1/2006 | Lu et al. | |
| 2006/0041952 A1 | 2/2006 | Cook | |
| 2006/0137034 A1 | 6/2006 | Schneeberger et al. | |
| 2006/0143735 A1 | 6/2006 | Medrano et al. | |
| 2006/0150283 A1 | 7/2006 | Alexandrov et al. | |
| 2006/0150285 A1 | 7/2006 | Nadzan et al. | |
| 2006/0168696 A1 | 7/2006 | Feldmann et al. | |
| 2006/0195934 A1 | 8/2006 | Apuya et al. | |
| 2006/0195943 A1 | 8/2006 | Feldmann et al. | |
| 2006/0236421 A1 | 10/2006 | Pennell et al. | |
| 2007/0006335 A1 | 1/2007 | Cook et al. | |
| 2007/0006345 A1 | 1/2007 | Alexandrov et al. | |
| 2007/0130645 A1 | 6/2007 | Wu et al. | |
| 2007/0199090 A1 | 8/2007 | Apuya et al. | |
| 2008/0184386 A1 | 7/2008 | Cao et al. | |
| 2013/0117881 A1 | 5/2013 | Cook et al. | |
| 2021/0062204 A1 | 3/2021 | Cook et al. | |

FOREIGN PATENT DOCUMENTS

| | | |
|---|---|---|
| EP | 1514941 A2 | 3/2005 |
| WO | WO-00/29566 | 5/2000 |
| WO | WO 01/44457 A2 * | 6/2001 |
| WO | WO 01/44457 A2 | 6/2001 |
| WO | WO-01/98480 A2 | 12/2001 |
| WO | WO-02/06487 | 1/2002 |
| WO | WO-0216655 | 2/2002 |
| WO | WO-2004/013169 | 2/2004 |
| WO | WO-2006/034479 A2 | 3/2006 |
| WO | WO-2006/066134 A2 | 6/2006 |
| WO | WO-20061076099 A2 | 7/2006 |

OTHER PUBLICATIONS

Kim et al. (1994) Plant Mol Biol 24:105-17.*
Dolferus et al. (1994) Plant Physiol 105:1075-87.*
Potenza et al. (2004) In Vitro Cell Dev Biol Plant 40:1-22.*
Nitz et al. (2001) Plant Sci 161 :337-46.*
Saha et al. (2007) In Silico Biol 7(1):7-19.*
Ko et al., DNA-binding specificities of the GATA transcription factor family, Molecular and Cellular Biology 13(7):4011-4022, 1993.
DATABASE Genbank [Online] Feb. 14, 2004, "*Arabidopsis thaliana* genomic DNA, chromosome 5, P1 clone: MNC17." retrieved from NCBI accession No. AB016890 BA000015.
Database EMBL Nov. 24, 2004 (Nov. 24, 2004) WiscDsLox 262009 *Arabidopsis thaliana* T-DNA insertion flanking sequences XP002372669.
Database EMBL Mar. 21, 2002 (Mar. 21, 2002) *Arabadopsis thaliana* cDNA clone: RAFL09-89-K19,5-end. XP002372670.
Database EMBL Apr. 23, 2002 (Apr. 23, 2002), *Arabadopsis thaliana* putative photoassimilate-responsive protein PAR (At5g52390) mRNA, complete cds. XP002372671.
Database Geneseq Oct. 18, 2000 (Oct. 18, 2000) *Arabadopsis thaliana* protein fragment SEQ ID No. 62052, XP002372672.
Shahmuradov, I., et al., PiantProm: a database of plant promoter sequences, *Nucleic Acids Research*, Oxford University Press, Surrey GB vol. 31, No. 1, 2003, pp. 114-117 XP002993034.
Database EMBL Nov. 16, 1998 (Nov. 16, 1998) *Arabidopsis thaliana* genomic DNA, chromosome 5, TAC clone: K24M7 XP002372668 retrieved from EBI accession No. EM_PRO:AT1217916, Database accession No. AT1217916, abstract.

(56) References Cited

OTHER PUBLICATIONS

Benfey, et al., *Science*, (1990), vol. 250, pp. 959-966.
Sato, et al., NCBI GenBank Sequence Accession No. AB022216, pp. 1-31 (Dec. 27, 2000).
Tyagi, et al., *Current Science*, (2001), vol. 80., pp. 161-169.
Manlatis, et al, *Molecular Cloning: A Laboratory Manual, Cold Spring Harbor Laboratory* (1982).
GenBank Accession No. NM 112618 (Apr. 20, 2007).
Shen, et al., *Plant J.*, (2002), vol. 29 (3), pp. 371-380.
Doerks, et al., *TIG*, (1998), vol. 14, pp. 248-250.
Smith, et al., *Nature Biotechnology*, (1994) vol. 15, pp. 1222-1223.
Bork, et al., *TIG*, (1996), vol. 12, pp. 425-427.
Guo, et al., *PNAS*, (2004), vol. 101, pp. 9205-9210.
Keskin, et al., *Protein Science*, (2004), vol. 13, pp. 1043-1055.
Thornton, et al., *Nature structural Biology, structural genomics supplement*, (Nov. 2000).
Wells, *Biochemistry*, (1990), vol. 29, pp. 8509-8517.
Miyoshi, et al., *Plant J*, (2003), vol. 36, pp. 532-540.
Ngo, et al., *The Protein Folding Problem and Tertiary Structure Prediction*, K. Merz and S. LeGrand (eds.), (1994), pp. 492-495.
Office Action dated May 7, 2009 for U.S. Appl. No. 11/097,589.
Kim et al., 1994, *Plant Molecular Biology* 24, pp. 105-117.
Donald et al., 1990, *EI/VIBO J.*, vol. 9, pp. 1717-1726.
Dolferus et al., 1994, *Plant Physiology*, 105, pp. 1075-1087.
Office Action dated May 13, 2009 in U.S. Appl. No. 11/058,689.
Asamizu et al., Structural analysis of *Arabidopsis thaliana* chromosome 5. VIII. Sequence features of the regions of 1,081,958 bp covered by seventeen physically assigned P1 and TAC clones. *DNA Res*. Dec. 31, 1998; 5 (6):379-91.
Office Action dated Jul. 28, 2008 in U.S. Appl. No. 11/058,689.
Rognes, S., et al., Transcriptional and biochemical regulation of a novel *Arabidopsis thaliana* bifunctional aspertate kinase-homoserine dehydrogenase gene isolated by functional complementation of a yeast hom6 mutant, *Plant Molecular Biology*, vol. 51, No. 2, Jan. 2003 (Jan. 2003), pp. 281-294, XP002363935.
Kuusk, S., et al., "STY1 and STY2 promote the formation of apical tissues during *Arabidopsis gynoecium* development," *Development* (Cambridge), vol. 29, No. 20, Oct. 2002 (Oct. 2002), pp. 4707-4717, XP002363936.
Jinn, T., et al., "Neese, an *Arabidopsis* leucine-rich repeat receptor kinase, controls floral organ abscission," *Genes and Development*, vol. 14, No. 1, Jan. 1, 2000 (Jan. 1, 2000), pp. 108-117, XP002363937.
Hong, S., et al., "Analysis of gene promoters for two tomato polygalacturonases expressed in abscission zones and the stigma," *Plant Physiology* (Rockville), vol. 123, No. 3, Jul. 2000 (Jul. 2000), pp. 869-881, XP002363938.
Nazoa, P., et al., "Regulation of the nitrate transporter gene AtNRT2.1 in *Arabidopsis thaliana*: Responses to nitrate, amino acids and developmental stage," Plant *Molecular Biology*, vol. 52, No. 3, Jun. 2003 (Jun. 2003), pp. 689-703, XP002363939.
Schonmann, P., et al., "Characterization of promoter expression patterns derived from the Pht1 phosphate transporter genes of barley (*Horcleum vulgare* L.)," Journal of Experimental Botany, vol. 55, No. 398, Apr. 2004 (Apr. 2004), pp. 855-865, XP002363940.
Database EMBL [Online] May 16, 1997 (May 16, 1997), "F21F10-T7 IGF *Arabidopsis thaliana* genomic clone F21F1 0, genomic survey sequence," XP002365435, retrieved from EBI. accession No. EM_PRO:AT1217916, Database accession No. AT1217916, abstract.
Database EMBL [Online] May 16, 2003 (May 16, 2003), "A stress-responsive promoter," XP002365436, retrieved from EBI accession No. EM_PRO:BD181334, Database accession No. BDI181334, abstract.
Nitz, I. et al., "PYK 10, A seedling and root specific gene and promoter from *Arabidopsis thaliana*" Plant Science, 161 (2001), pp. 337-346.
Database EMBL [Online] Print Out, "*Arabadopsis thaliana* BAC F9D12." Jul. 17, 1998. Database Accession No. AF077407. XP002381460.

Database EMBL [Online] Print Out, "*Arabadopsis thaliana* BAC T19G15, from chromosome V near 60.5 cM, complete sequence." Nov. 16, 1998. Accession No. Ac005965. XP002381461.
Database EMBL (online), *Arabidopsis thaliana* DNA chromosome 5, BAC clone T1008 (ESSA project) retrieved from EBI accession No. EM_PL: AL161746, Database accession No. AL161746, Mar. 21, 2000.
Rombauts, S., et al., "Computational Approaches to Identify Promoters and Cis-regulatory Elements in Plant Genomes," *Plant Physiology*, 132 (3): pp. 1162-1176, Jul. 2003.
Ciaffi, M., et al., "Cloning and Characterization of Wheat PDI (Protein Disulfied Isomerase) Homoeologous Genes and Promoter Sequences," *Gene*, 366 (2): pp. 209-218, Nov. 11, 2005.
Genoscope, Accession No. AL063921 (Jun. 1999).
Alonso et al., Accession No. BH750696 (Feb. 2002).
Murray et al., Accession No. F9D12 (Nov. 1999).
Mollier et al., *Plant Cell Reports* 19(11): 1076-1083 (Nov. 2000).
Bevan, NCBI, GenBank, Sequence Accession No. AL035526 (1999).
Kaneko et al., 1999, *DNA Research* 6:183-195.
Li, L., et al. "An upstream repressor element that contributes to hepatocyte-specific expression of the rat serum amyloid AI gene", *Biochem Biophys Res Commun*, (1999), vol. 264, pp. 395-403.
Thomas, B., et al., "Glucose mediates transcriptional repression of the human angiotensin type-1 receptor aerie", *Mel Bio Cell*, (2004), vol. 15, pp. 4347-4355.
T-DNA integration into the *Arabidopsis* genome on sequences Report, *EMBO Reports*, vol. 3, No. 12, pp. 1152-1157. 2002.
Sato et al., *DNA Research* 7:131-135, alignment provided in body of office action.
Nature, 408, pp. 816-820, Dec. 14, 2000, STY1 and STY2 promote the formation of apical tissues during *Arabidopsis gynoecium* development.
Sato et al., Structural analysis of *Arabidopsis thaliana* chromosome 5. X. Sequence features of the regions of 3,076,755 bp covered by sixty P1 and TAC clones, *DNA Res*. Feb. 28, 2000;7(1):31-63.
Pennell—SEQ Alignment (2011).
An et al., 1986, *Plant Physiol*. 81:301-305.
Padgette et al., 1995, *Crop Sci*. 35:1451-1461.
AC011914 (*Arabidopsis thaliana* chromosome 1 BAC F14K14 genomic sequence), NCBI database, Jan. 19, 2001.
Noll, G. et al., "Spatial and temporal regulation of the forisome gene fort in the phloem during plant development", 2007, *Plant Molecular Biology*, vol. 65, pp. 285-294.
Takada, S., et al., Transcriptional regulation of epidermal cell fate in the *Arabidopsis* embryo, 2007, Development, vol. 134, pp. 1141-1150.
Kim, M., et al., "Seed-specific expression of sesame microsomal oleic acid desaturase is controlled by combinatorial properties between negative is-regulatory elements in the SeFAD2. promoter and enhancers in the 5-UTR intron", 2006, *Mol Gen Genomics*, vol. 276, pp. 351-368.
Sato et al., "*Arabidopsis thaliana* genomic DNA, chromosome 5, P1 clone: MBKS," NCBI nucleotide database, AB005234, Feb. 14, 2004 (Feb. 14, 2004).
Office Action issued in corresponding Canadian Application No. 2,713,138 dated Jun. 4, 2012.
Welsch et al., *Planta* 216:523-34 (2006).
Piechulla et al., *Plant Mol Biol* 38:655-62 (1998).
Cho & Cosgrove, *Plant Cell* 14: 3237-53 (2002).
Potenza et al., In Vitro Cell Dev Biol *Plant* 40:1-22 (2004).
GenBank AAK25877.1, 2002.
Lebel et al., *Plant J* 16(2):223-33 (1998).
Kaneko et al., AB011483 (1998).
Saha et al., In Silico *Biol* 7(1):7-19 (2007).
Vvelsch, R., et al., "Structural and functional characterization of the phytoene synthase promoter from *Arabidopsis thaliana*," *Planta*, Sep. 18, 2002, pp. 523-534.
Lopez-Valenzuela et al., *Plant Physiol* 133(3):1285-95 (2003).
Yang et al., *Crop Sci* 43(5):1805-13 (2003).
Suhandono et al., *PLoS ONE* 9(1):e84692 (2014).
Amendment filed Jan. 27, 2009 in response to Non-Final Office Action dated Jul. 28, 2008 from U.S. Appl. No. 11/058,689.

(56) References Cited

OTHER PUBLICATIONS

Office Action (Restriction Requirement) dated Mar. 26, 2008 from U.S. Appl. No. 11/058.689.
Reply to Restriction Requirement filed Apr. 25, 2008 in response to Office Action dated Mar. 26, 2008 from U.S. Appl. No. 11/058.689.
Reply Under 37 CFR Section 1.116 filed Sep. 14, 2009 in response to Office Action dated May 13, 2009 from U.S. Appl. No. 11/058,689.
Lu et al. (2012) Gene 503:65-74.
Donald et al., (1990) EMBO J 9:1717-26.

* cited by examiner

PROMOTER, PROMOTER CONTROL ELEMENTS, AND COMBINATIONS, AND USES THEREOF

CROSS REFERENCES TO RELATED APPLICATIONS

This application is a Divisional of application Ser. No. 15/967,437 filed Apr. 30, 2018 which is a Continuation of application Ser. No. 13/664,313 filed Oct. 30, 2012 which is a Continuation-in-Part of co-pending application Ser. No. 12/865,719 filed on Apr. 19, 2011, and for which priority is claimed under 35 U.S.C. § 120. application Ser. No. 12/865,719 is the National Stage of PCT/US2009/032485 filed on Jan. 29, 2009 which claims priority under 35 U.S.C. § 119(e) on U.S. Provisional Application No. 61/025,697 filed on Feb. 1, 2008; the entire contents of each of which are hereby incorporated by reference.

This application is a Continuation-in-Part of co-pending application Ser. No. 13/550,341 filed on Jul. 16, 2012, and for which priority is claimed under 35 U.S.C. § 120. application Ser. No. 13/550,341 is a Continuation-in-Part of co-pending application Ser. No. 12/891,723 filed on Sep. 27, 2010. application Ser. No. 12/891,723 is a Divisional of application Ser. No. 11/600,953, now U.S. Pat. No. 7,851,608, filed on Nov. 14, 2006. application Ser. No. 11/600,953 is a Divisional of application Ser. No. 10/957,569, now U.S. Pat. No. 7,402,667, filed on Sep. 30, 2004. application Ser. No. 10/957,569 is a Continuation-in-Part of application Ser. No. 10/950,321, now U.S. Pat. No. 7,173,121, filed on Sep. 23, 2004 which claims priority under 35 U.S.C. § 119(e) on U.S. Provisional Application No. 60,505,689 filed on Sep. 23, 2003; Application No. 60,511,460 filed on Oct. 14, 2003; Application No. 60/518,075 filed on Nov. 6, 2003; Application No. 60/527,611 filed on Dec. 4, 2003; Application No. 60/529,352 filed on Dec. 12, 2003 and Application No. 60/544,771 filed on Feb. 13, 2004; and Application No. 60/583,691 filed on Jun. 30, 2004, the entire contents of each of which are hereby incorporated by reference, including their sequence listings.

application Ser. No. 13/550,341 is a Continuation-in-Part of application Ser. No. 12/504,863, now U.S. Pat. No. 8,278,434, filed on Jul. 17, 2009, which is a Continuation of application Ser. No. 11/598,118, now abandoned, filed Nov. 10, 2006. application Ser. No. 11/598,118 is a Division of Ser. No. 10/950,321, now U.S. Pat. No. 7,173,121, filed Sep. 23, 2004, which claims priority under 35 U.S.C. § 119(e) on U.S. Provisional Application No. 60,505,689 filed on Sep. 23, 2003; Application No. 60,511,460 filed on Oct. 14, 2003; Application No. 60/518,075 filed on Nov. 6, 2003; Application No. 60/527,611 filed on Dec. 4, 2003; Application No. 60/529,352 filed on Dec. 12, 2003 and Application No. 60/544,771 filed on Feb. 13, 2004; and Application No. 60/583,691 filed on Jun. 30, 2004, the entire contents of each of which are hereby incorporated by reference, including their sequence listings.

application Ser. No. 13/550,341 is a Continuation-in-Part of application Ser. No. 10/965,470, now U.S. Pat. No. 7,169,915, filed on Oct. 13, 2004, and for which priority is claimed under 35 U.S.C. § 120; and this application claims priority under 35 U.S.C. § 119(e) of Application No. 60/511,460, filed on Oct. 13, 2003, the entire contents of each of which are hereby incorporated by reference, including their sequence listings.

application Ser. No. 13/550,341 is a Continuation-in-Part of co-pending application Ser. No. 12/103,970 filed on Apr. 16, 2008, and for which priority is claimed under 35 U.S.C. § 120. application Ser. No. 12/103,970 is a Divisional of application Ser. No. 11/233,726, now U.S. Pat. No. 7,378,571, filed on Sep. 23, 2005 which claims priority under 35 U.S.C. § 119(e) on U.S. Provisional Application No. 60/612,891 filed on Sep. 23, 2004; Application No. 60/613,134 filed on Sep. 23, 2004; and Application No. 60/637,174 filed on Dec. 16, 2004; the entire contents of each of which are hereby incorporated by reference, including their sequence listings.

application Ser. No. 13/550,341 is a Continuation-in-Part of co-pending application Ser. No. 12/343,190 filed on Dec. 23, 2008, and for which priority is claimed under 35 U.S.C. § 120. application Ser. No. 12/343,190 is a Divisional of application Ser. No. 11/603,542, now U.S. Pat. No. 7,868,155, filed on Nov. 22, 2006 which is a Divisional of application Ser. No. 10/981,334, now U.S. Pat. No. 7,179,904, filed on Nov. 4, 2004 which claims priority under 35 U.S.C. § 119(e) on U.S. Provisional Application No. 60/518,075 filed on Nov. 6, 2003; and Application No. 60/527,611 filed on Dec. 4, 2003; the entire contents of each of which are hereby incorporated by reference, including their sequence listings.

application Ser. No. 13/550,341 is a Continuation-in-Part of co-pending application Ser. No. 12/502,117 filed on Jul. 13, 2009, and for which priority is claimed under 35 U.S.C. § 120. application Ser. No. 12/502,117 is a Continuation of application Ser. No. 12/123,699, now abandoned, filed on May 20, 2008 which is a Divisional of application Ser. No. 11/305,589, now U.S. Pat. No. 7,385,105, filed on Dec. 16, 2005 which claims priority under 35 U.S.C. § 119(e) on U.S. Provisional Application No. 60/637,140 filed on Dec. 16, 2004; the entire contents of each of which are hereby incorporated by reference, including their sequence listings.

application Ser. No. 13/550,341 is a Continuation-in-Part of co-pending application Ser. No. 12/575,402 filed on Oct. 7, 2009, and for which priority is claimed under 35 U.S.C. § 120. application Ser. No. 12/575,402 is a Continuation of application Ser. No. 11/097,589, now abandoned, filed on Apr. 1, 2005 which claims priority under 35 U.S.C. § 119(e) on U.S. Provisional Application No. 60/558,869 filed on Apr. 1, 2004; the entire contents of each of which are hereby incorporated by reference, including their sequence listings.

application Ser. No. 13/550,341 is a Continuation-in-Part of co-pending application Ser. No. 12/698,056 filed on Feb. 1, 2010, and for which priority is claimed under 35 U.S.C. § 120. application Ser. No. 12/698,056 is a Continuation of co-pending application Ser. No. 12/294,418 filed on Aug. 18, 2010, which is the National Stage of PCT/US2007/64848 filed on Mar. 23, 2007 which claims priority under 35 U.S.C. § 119(e) on U.S. Provisional Application No. 60/785,794 filed on Mar. 24, 2006; the entire contents of each of which are hereby incorporated by reference, including their sequence listings.

application Ser. No. 13/550,341 is a Continuation-in-Part of co-pending application Ser. No. 12/891,689 filed on Sep. 27, 2010, and for which priority is claimed under 35 U.S.C. § 120. application Ser. No. 12/981,689 is a Divisional of application Ser. No. 11/602,163, now U.S. Pat. No. 7,838,650, filed on Nov. 20, 2006 which is a Divisional of application Ser. No. 11/172,703, now U.S. Pat. No. 7,214,789, filed on Jun. 30, 2005 which claims priority under 35 U.S.C. § 119(e) on U.S. Provisional Application No. 60/583,691 filed on Jun. 30, 2004; and Application No. 60/583,609 filed on Jun. 30, 2004; the entire contents of each of which are hereby incorporated by reference, including their sequence listings.

FIELD OF THE INVENTION

The present invention relates to promoters and promoter control elements that are useful for modulating transcription of a desired polynucleotide. Such promoters and promoter control elements can be included in polynucleotide constructs, expression cassettes, vectors, or inserted into the chromosome or as an exogenous element, to modulate in vivo and in vitro transcription of a polynucleotide. Host cells, including plant cells, and organisms, such as regenerated plants therefrom, with desired traits or characteristics using polynucleotides comprising the promoters and promoter control elements of the present invention are also a part of the invention.

BACKGROUND OF THE INVENTION

This invention relates to the field of biotechnology and, in particular, to specific promoter sequences and promoter control element sequences which are useful for the transcription of polynucleotides in a host cell or transformed host organism.

One of the primary goals of biotechnology is to obtain organisms, such as plants, mammals, yeast, and prokaryotes having particular desired characteristics or traits. Examples of these characteristic or traits abound and may include, for example, in plants, virus resistance, insect resistance, herbicide resistance, enhanced stability or additional nutritional value. Recent advances in genetic engineering have enabled researchers in the field to incorporate polynucleotide sequences into host cells to obtain the desired qualities in the organism of choice. This technology permits one or more polynucleotides from a source different than the organism of choice to be transcribed by the organism of choice. If desired, the transcription and/or translation of these new polynucleotides can be modulated in the organism to exhibit a desired characteristic or trait. Alternatively, new patterns of transcription and/or translation of polynucleotides endogenous to the organism can be produced. Both approaches can be used at the same time.

SUMMARY OF THE INVENTION

The present invention is directed to isolated polynucleotide sequences that comprise promoters and promoter control elements from plants, especially *Arabidopsis thaliana*, *Glycine max*, *Oryza sativa*, and *Zea mays*, and other promoters and promoter control elements functional in plants.

It is an object of the present invention to provide isolated polynucleotides that are promoter sequences. These promoter sequences comprise, for example, (1) a polynucleotide having a nucleotide sequence as set forth in Table 1, in the section entitled "The predicted promoter sequence" or fragment thereof;

(2) a polynucleotide having a nucleotide sequence having at least 80% sequence identity to a sequence as set forth in Table 1, in the section entitled "The predicted promoter sequence" or fragment thereof; and (3) a polynucleotide having a nucleotide sequence which hybridizes to a sequence as set forth in Table 1, in the section entitled "The predicted promoter sequence" under a condition establishing a Tm–20° C.

It is another object of the present invention to provide isolated polynucleotides that are promoter control element sequences. These promoter control element sequences comprise, for example, (1) a polynucleotide having a nucleotide sequence as set forth in Table 1, in the section entitled "The predicted promoter sequence" or fragment thereof;

(2) a polynucleotide having a nucleotide sequence having at least 80% sequence identity to a sequence as set forth in Table 1, in the section entitled "The predicted promoter sequence" or fragment thereof; and (3) a polynucleotide having a nucleotide sequence which hybridizes to a sequence as set forth in Table 1, in the section entitled "The predicted promoter sequence" under a condition establishing a Tm–20° C.

Promoter or promoter control element sequences of the present invention are capable of modulating preferential transcription.

In another embodiment, the present promoter control elements are capable of serving as or fulfilling the function, for example, as a core promoter, a TATA box, a polymerase binding site, an initiator site, a transcription binding site, an enhancer, an inverted repeat, a locus control region, or a scaffold/matrix attachment region.

It is yet another object of the present invention to provide a polynucleotide that includes at least a first and a second promoter control element. The first promoter control element is a promoter control element sequence as discussed above, and the second promoter control element is heterologous to the first control element. Moreover, the first and second control elements are operably linked. Such promoters may modulate transcript levels preferentially in a tissue or under particular conditions.

In another embodiment, the present isolated polynucleotide comprises a promoter or a promoter control element as described above, wherein the promoter or promoter control element is operably linked to a polynucleotide to be transcribed.

In another embodiment of the present vector, the promoter and promoter control elements of the instant invention are operably linked to a heterologous polynucleotide that is a regulatory sequence.

It is another object of the present invention to provide a host cell comprising an isolated polynucleotide or vector as described above or fragment thereof. Host cells include, for instance, bacterial, yeast, insect, mammalian, and plant. The host cell can comprise a promoter or promoter control element exogenous to the genome. Such a promoter can modulate transcription in cis- and in trans-.

In yet another embodiment, the present host cell is a plant cell capable of regenerating into a plant.

It is yet another embodiment of the present invention to provide a plant comprising an isolated polynucleotide or vector described above.

It is another object of the present invention to provide a method of modulating transcription in a sample that contains either a cell-free system of transcription or host cell. This method comprises providing a polynucleotide or vector according to the present invention as described above, and contacting the sample of the polynucleotide or vector with conditions that permit transcription.

In another embodiment of the present method, the polynucleotide or vector preferentially modulates (a) constitutive transcription,
(b) stress induced transcription,
(c) light induced transcription,
(d) dark induced transcription,
(e) leaf transcription,
(f) root transcription,
(g) stem or shoot transcription,
(h) silique transcription, (i) callus transcription,
(j) flower transcription,
(k) immature bud and inflorescence specific transcription, or
(l) senescing induced transcription
(m) germination transcription.

Other and further objects of the present invention will be made clear or become apparent from the following description.

BRIEF DESCRIPTION OF THE TABLES AND FIGURES

TABLE 1

Table 1 consists of the Expression Reports for each promoter of the invention providing the nucleotide sequence for each promoter and details for expression driven by each of the nucleic acid promoter sequences as observed in transgenic plants. The results are presented as summaries of the spatial expression, which provides information as to gross and/or specific expression in various plant organs and tissues. The observed expression pattern is also presented, which gives details of expression during different generations or different developmental stages within a generation. Additional information is provided regarding the associated gene, the GenBank reference, the source organism of the promoter, and the vector and marker genes used for the construct. The following symbols are used consistently throughout the Table:

T1: First generation transformant
T2: Second generation transformant
T3: Third generation transformant
(L): low expression level
(M): medium expression level
(H): high expression level Each row of the table begins with heading of the data to be found in the section. The following provides a description of the data to be found in each section:

| Heading in Table 1 | Description |
|---|---|
| Promoter | Identifies the particular promoter by its construct ID. |
| Modulates the gene: | This row states the name of the gene modulated by the promoter |
| The GenBank description of the gene: | This field gives the Locus Number of the gene as well as the accession number. |
| The predicted promoter sequence: | Identifies the nucleic acid promoter sequence in question. |
| The promoter was cloned from the organism: | Identifies the source of the DNA template used to clone the promoter. |
| The experimental promoter sequence: | Identifies the nucleic acid sequence in planta driving expression of the reporter gene. |
| The promoter was cloned in the vector: | Identifies the vector used into which a promoter was cloned. |
| When cloned into the vector the promoter was operably linked to a marker, which was the type: | Identifies the type of marker linked to the promoter. The marker is used to determine patterns of gene expression in plant tissue. |
| Promoter-marker vector was tested in: | Identifies the organism in which the promoter-marker vector was tested. |
| Generation screened: T1 Mature T2 Seedling T2 Mature T3 Seedling | Identifies the plant generation(s) used in the screening process. T1 plants are those plants subjected to the transformation event while the T2 generation plants are from the seeds collected from the T1 plants and T3 plants are from the seeds of T2 plants. |
| The spatial expression of the promoter-marker vector was found observed in and would be useful in expression in any or all of the following: | Identifies the specific parts of the plant where various levels of GFP expression are observed. Expression levels are noted as either low (L), medium (M), or high (H). |
| Observed expression pattern of the promoter-marker vector was in:<br>T1 mature:<br>T2 seedling: | Identifies a general explanation of where GFP expression in different generations of plants was observed. |
| The promoter can be of use in the following trait and sub-trait areas: (search for the trait and sub-trait table) | Identifies which traits and subtraits the promoter cDNA can modulate |
| The promoter has utility in: | Identifies a specific function or functions that can be modulated using the promoter cDNA. |
| Misc. promoter information:<br>Bidirectionality:<br>Exons:<br>Repeats: | "Bidirectionality" is determined by the number of base pairs between the promoter and the start codon of a neighboring gene. A promoter is considered bidirectional if it is closer than 200 bp to a start codon of a gene 5' or 3' to the promoter. "Exons" (or any coding sequence) identifies if the promoter has overlapped with either the modulating gene's or other neighboring gene's coding sequence. A "fail" for exons means that this overlap has occurred. "Repeats" identifies the presence of normally occurring sequence repeats that randomly exist throughout the genome. A "pass" for repeats indicates a lack of repeats in the promoter. |

| Heading in Table 1 | Description |
| --- | --- |
| An overlap in an exon with the endogenous coding sequence to the promoter occurs at base pairs: | Identifies the specific nucleotides overlapping the UTR region or exon of a neighboring gene. The orientation relative to the promoter is designated with a 5' or 3'. |
| The Ceres cDNA ID of the endogenous coding sequence to the promoter: | Identifies the number associated with the Ceres cDNA that corresponds to the endogenous cDNA sequence of the promoter. |
| cDNA nucleotide sequence: | The nucleic acid sequence of the Ceres cDNA matching the endogenous cDNA region of the promoter. |
| Coding sequence: | A translated protein sequence of the gene modulated by a protein encoded by a cDNA |
| Microarray Data shows that the coding sequence was expressed in the following experiments, which shows that the promoter would useful to modulate expression in situations similar to the following: | Microarray data is identified along with the corresponding experiments along with the corresponding gene expression. Gene expression is identified by a "+" or a "−" in the "SIGN(LOG_RATIO)" column. A "+" notation indicates the cDNA is upregulated while a "−" indicates that the cDNA is downregulated. The "SHORT_NAME" field describes the experimental conditions. |
| The parameters for the microarray experiments listed above by EXPT_REP_ID and Short_Name are as follow below: | Parameters for microarray experiments include age, organism, specific tissues, age, treatments and other distinguishing characteristics or features. |

TABLE 2

Table 1 provides the results of differential expression experiments indicating if the expression levels were increased ("+") or decreased ("−"). Such increase or decrease expression levels indicates the utility of the corresponding promoter. The following Table 2 correlates the various differential expression experiments with the utility for the promoter that would be understood from an increased or decreased expression. Table 2 includes three columns, the first column ("EXPT_REP_ID") lists the microarray experiments by their experimental prep ID number and correspond to the same number listings in Table 1 in the "Microarray data" section. The second column lists the Short_Name of the experiment that corresponds to the EXPT_REP_ID. When a cDNA is differentially expressed in an experiment, identified by its EXPT_REP_ID, the cDNA and its endogenous promoter can be used to modulate the traits and subtraits listed in the third column.

FIG. 1

FIG. 1 is a schematic representation of the vector pNewBin4-HAP1-GFP. The definitions of the abbreviations used in the vector map are as follows:

Ori—the origin of replication used by an *E. coli* host

RB—sequence for the right border of the T-DNA from pMOG800

BstXI—restriction enzyme cleavage site used for cloning

HAP1VP16—coding sequence for a fusion protein of the HAP1 and VP16 activation domains NOS—terminator region from the nopaline synthase gene HAP1UAS—the upstream activating sequence for HAP1

5ERGFP—the green fluorescent protein gene that has been optimized for localization to the endoplasmic reticulum OCS2—the terminator sequence from the octopine synthase 2 gene OCS—the terminator sequence from the octopine synthase gene p28716 (a.k.a 28716 short)—promoter used to drive expression of the PAT (BAR) gene PAT (BAR)—a marker gene conferring herbicide resistance LB—sequence for the left border of the T-DNA from pMOG800

Spec—a marker gene conferring spectinomycin resistance

TrfA—transcription repression factor gene

RK2-OriV—origin of replication for *Agrobacterium*

FIG. 2

Figure 2:
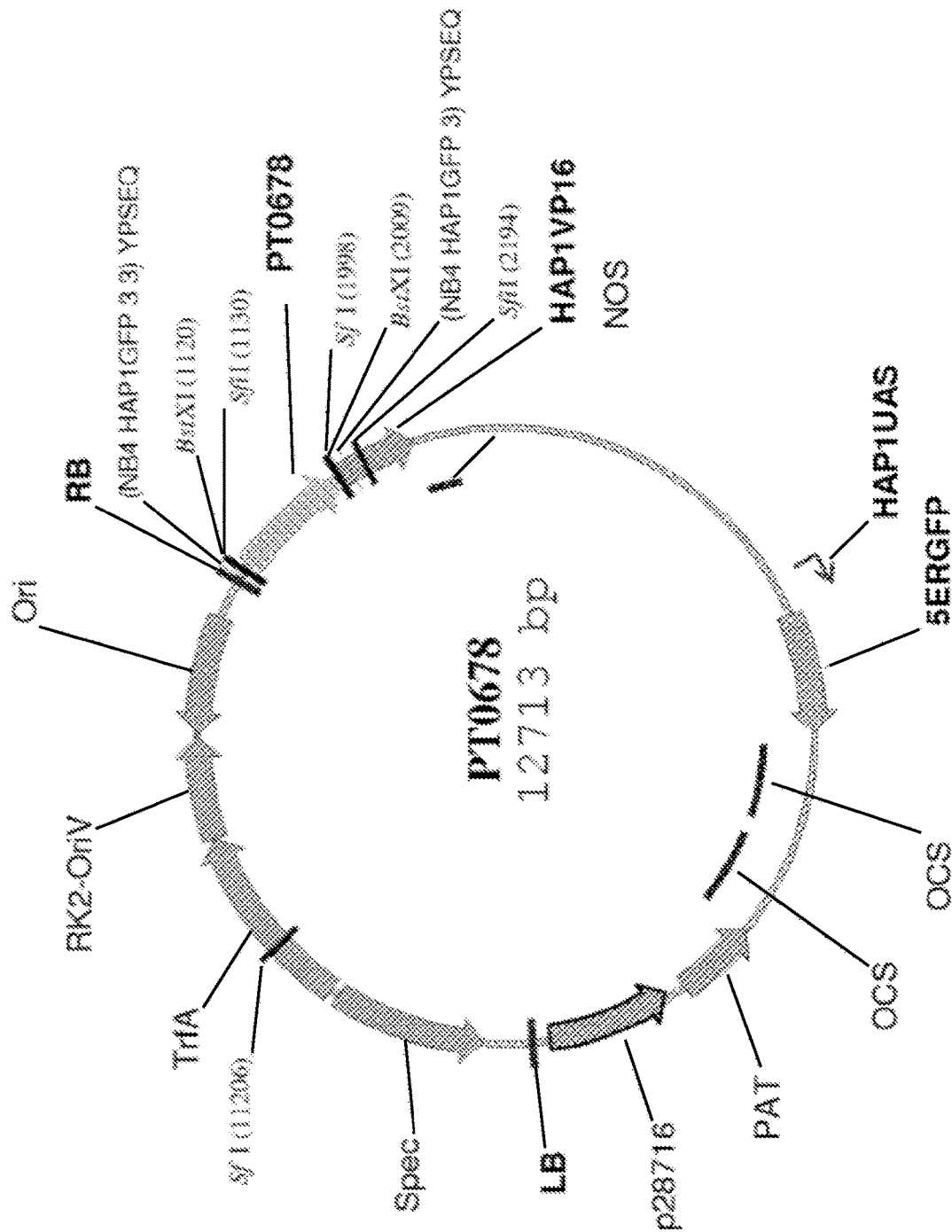

FIG. 2 is a schematic representation of the vector PT0678. The definitions of the abbreviations used in the vector map are as described above.

FIG. 3

Figure 3:
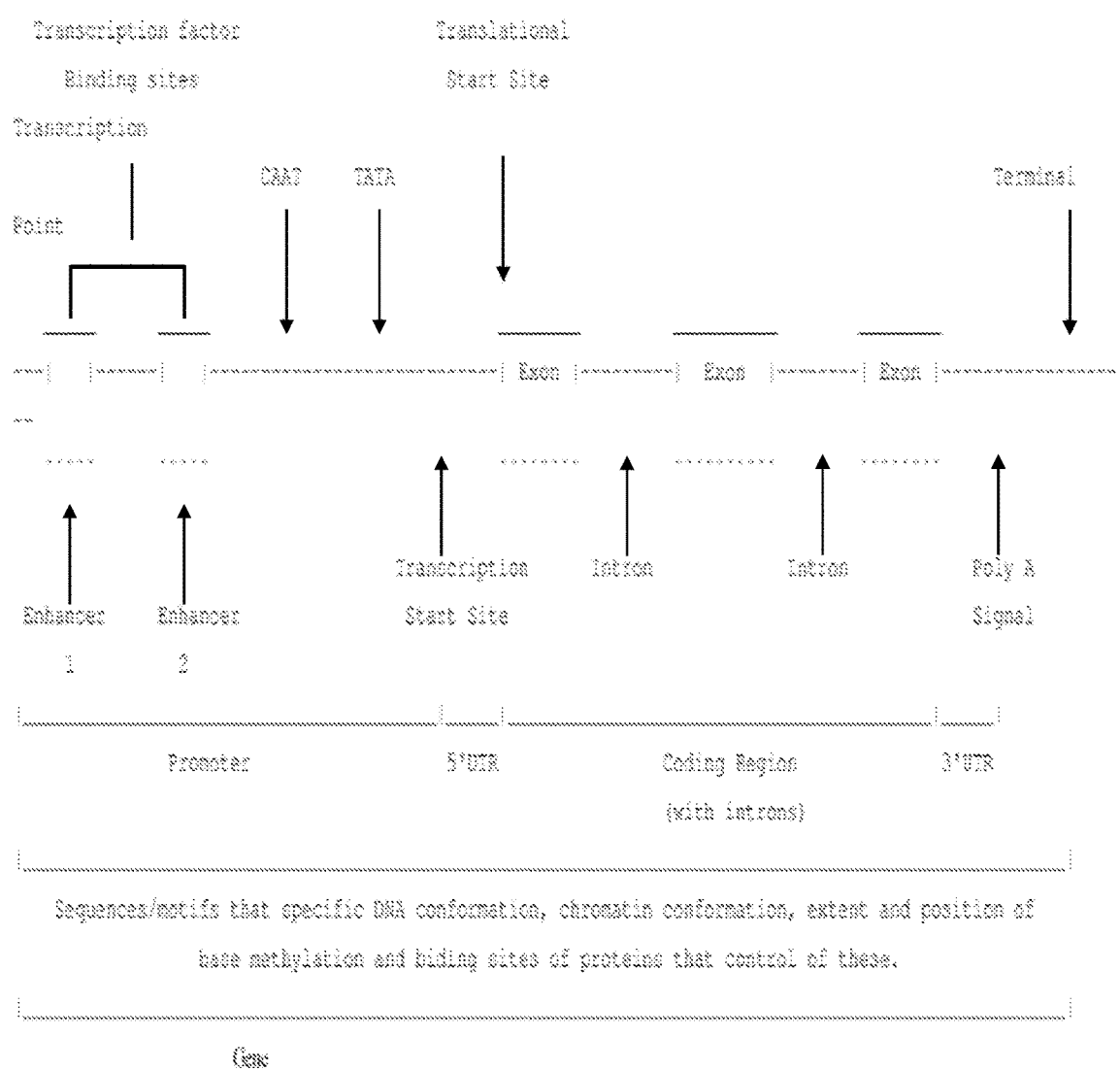

FIG. 3 is a schematic of a gene.

DETAILED DESCRIPTION OF THE INVENTION

1. Definitions

Chimeric: The term "chimeric" is used to describe polynucleotides or genes, as defined supra, or constructs wherein at least two of the elements of the polynucleotide or gene or construct, such as the promoter and the polynucleotide to be transcribed and/or other regulatory sequences and/or filler sequences and/or complements thereof, are heterologous to each other.

Constitutive Promoter: Promoters referred to herein as "constitutive promoters" actively promote transcription under most, but not necessarily all, environmental conditions and states of development or cell differentiation. Examples of constitutive promoters include the cauliflower mosaic virus (CaMV) 35S transcript initiation region and the 1' or 2' promoter derived from T-DNA of *Agrobacterium tumefaciens*, and other transcription initiation regions from various plant genes, such as the maize ubiquitin-1 promoter, known to those of skill.

Core Promoter: This is the minimal stretch of contiguous DNA sequence that is sufficient to direct accurate initiation of transcription by the RNA polymerase II machinery (for review see: Struhl, 1987, *Cell* 49: 295-297; Smale, 1994, In *Transcription: Mechanisms and Regulation* (eds R. C. Conaway and J. W. Conaway), pp 63-81/Raven Press, Ltd., New York; Smale, 1997, *Biochim Biophys. Acta* 1351: 73-88; Smale et al., 1998, Cold Spring Harb. *Symp. Quant. Biol.* 58: 21-31; Smale, 2001, Genes & Dev. 15: 2503-2508; Weis and Reinberg, 1992, *FASEB J.* 6: 3300-3309; Burke et al., 1998, Cold Spring Harb. *Symp. Quant. Biol* 63: 75-82). There are several sequence motifs, including the TATA box, initiator (Inr), TFIIB recognition element (BRE) and downstream core promoter element (DPE), that are commonly found in core promoters, however not all of these elements occur in all promoters and there are no universal core promoter elements (Butler and Kadonaga, 2002, Genes & Dev. 16: 2583-2592).

Domain: Domains are fingerprints or signatures that can be used to characterize protein families and/or parts of proteins. Such fingerprints or signatures can comprise conserved (1) primary sequence, (2) secondary structure, and/or (3) three-dimensional conformation. A similar analysis can be applied to polynucleotides. Generally, each domain has been associated with either a conserved primary sequence or a sequence motif. Generally these conserved primary sequence motifs have been correlated with specific in vitro and/or in vivo activities. A domain can be any length, including the entirety of the polynucleotide to be transcribed. Examples of domains include, without limitation, AP2, helicase, homeobox, zinc finger, etc.

Endogenous: The term "endogenous," within the context of the current invention refers to any polynucleotide, polypeptide or protein sequence which is a natural part of a cell or organisms regenerated from said cell. In the context of promoter, the term "endogenous coding region" or "endogenous cDNA" refers to the coding region that is naturally operably linked to the promoter.

Enhancer/Suppressor: An "enhancer" is a DNA regulatory element that can increase the steady state level of a transcript, usually by increasing the rate of transcription initiation. Enhancers usually exert their effect regardless of the distance, upstream or downstream location, or orientation of the enhancer relative to the start site of transcription. In contrast, a "suppressor" is a corresponding DNA regulatory element that decreases the steady state level of a transcript, again usually by affecting the rate of transcription initiation. The essential activity of enhancer and suppressor elements is to bind a protein factor(s). Such binding can be assayed, for example, by methods described below. The binding is typically in a manner that influences the steady state level of a transcript in a cell or in an in vitro transcription extract.

Exogenous: As referred to within, "exogenous" is any polynucleotide, polypeptide or protein sequence, whether chimeric or not, that is introduced into the genome of a host cell or organism regenerated from said host cell by any means other than by a sexual cross. Examples of means by which this can be accomplished are described below, and include *Agrobacterium*-mediated transformation (of dicots—e.g. Salomon et al. EMBO J. 3:141 (1984); Herrera-Estrella et al. EMBO J. 2:987 (1983); of monocots, representative papers are those by Escudero et al., Plant J. 10:355 (1996), Ishida et al., Nature Biotechnology 14:745 (1996), May et al., Bio/Technology 13:486 (1995)), biolistic methods (Armaleo et al., Current Genetics 17:97 1990)), electroporation, in planta techniques, and the like. Such a plant containing the exogenous nucleic acid is referred to here as a $T_0$ for the primary transgenic plant and $T_1$ for the first generation. The term "exogenous" as used herein is also intended to encompass inserting a naturally found element into a non-naturally found location.

Gene: The term "gene," as used in the context of the current invention, encompasses all regulatory and coding sequence contiguously associated with a single hereditary unit with a genetic function. Genes can include non-coding sequences that modulate the genetic function that include, but are not limited to, those that specify polyadenylation, transcriptional regulation, DNA conformation, chromatin conformation, extent and position of base methylation and binding sites of proteins that control all of these. Genes encoding proteins are comprised of "exons" (coding sequences), which may be interrupted by "introns" (non-coding sequences). In some instances complexes of a plurality of protein or nucleic acids or other molecules, or of any two of the above, may be required for a gene's function. On the other hand a gene's genetic function may require only RNA expression or protein production, or may only require binding of proteins and/or nucleic acids without associated expression. In certain cases, genes adjacent to one another may share sequence in such a way that one gene will overlap the other. A gene can be found within the genome of an organism, in an artificial chromosome, in a plasmid, in any other sort of vector, or as a separate isolated entity.

Heterologous sequences: "Heterologous sequences" are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence originates from, are considered heterologous to said coding sequence. Elements operatively linked in nature and contiguous to each other are not heterologous to each other.

Homologous: In the current invention, a "homologous" gene or polynucleotide or polypeptide refers to a gene or polynucleotide or polypeptide that shares sequence similarity with the gene or polynucleotide or polypeptide of interest. This similarity may be in only a fragment of the sequence and often represents a functional domain such as, examples including without limitation a DNA binding domain or a domain with tyrosine kinase activity. The functional activities of homologous polynucleotide are not necessarily the same.

Inducible Promoter: An "inducible promoter" in the context of the current invention refers to a promoter, the activity of which is influenced by certain conditions, such as light, temperature, chemical concentration, protein concentration, conditions in an organism, cell, or organelle, etc. A typical example of an inducible promoter, which can be utilized with the polynucleotides of the present invention, is PARSK1, the promoter from an *Arabidopsis* gene encoding a serine-threonine kinase enzyme, and which promoter is induced by dehydration, abscissic acid and sodium chloride (Wang and Goodman, Plant J. 8:37 (1995)). Examples of environmental conditions that may affect transcription by inducible promoters include anaerobic conditions, elevated temperature, the presence or absence of a nutrient or other chemical compound or the presence of light.

Modulate Transcription Level: As used herein, the phrase "modulate transcription" describes the biological activity of a promoter sequence or promoter control element. Such modulation includes, without limitation, includes up- and down-regulation of initiation of transcription, rate of transcription, and/or transcription levels.

Mutant: In the current invention, "mutant" refers to a heritable change in nucleotide sequence at a specific location. Mutant genes of the current invention may or may not have an associated identifiable phenotype.

Operable Linkage: An "operable linkage" is a linkage in which a promoter sequence or promoter control element is connected to a polynucleotide sequence (or sequences) in such a way as to place transcription of the polynucleotide sequence under the influence or control of the promoter or promoter control element. Two DNA sequences (such as a polynucleotide to be transcribed and a promoter sequence linked to the 5' end of the polynucleotide to be transcribed) are said to be operably linked if induction of promoter function results in the transcription of mRNA encoding the polynucleotide and if the nature of the linkage between the two DNA sequences does not (1) result in the introduction of a frame-shift mutation, (2) interfere with the ability of the promoter sequence to direct the expression of the protein, antisense RNA or ribozyme, or (3) interfere with the ability of the DNA template to be transcribed. Thus, a promoter sequence would be operably linked to a polynucleotide sequence if the promoter was capable of effecting transcription of that polynucleotide sequence.

Optional Promoter Fragments: The phrase "optional promoter fragments" is used to refer to any sub-sequence of the promoter that is not required for driving transcription of an operationally linked coding region. These fragments comprise the 5' UTR and any exon(s) of the endogenous coding region. The optional promoter fragments may also comprise any exon(s) and the 3' or 5' UTR of the gene residing upstream of the promoter (that is, 5' to the promoter). Optional promoter fragments also include any intervening sequences that are introns or sequence that occurs between exons or an exon and the UTR.

Orthologous: "Orthologous" is a term used herein to describe a relationship between two or more polynucleotides or proteins. Two polynucleotides or proteins are "orthologous" to one another if they serve a similar function in different organisms. In general, orthologous polynucleotides or proteins will have similar catalytic functions (when they encode enzymes) or will serve similar structural functions (when they encode proteins or RNA that form part of the ultrastructure of a cell).

Percentage of sequence identity: "Percentage of sequence identity," as used herein, is determined by comparing two optimally aligned sequences over a comparison window, where the fragment of the polynucleotide or amino acid sequence in the comparison window may comprise additions or deletions (e.g., gaps or overhangs) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Optimal alignment of sequences for comparison may be conducted by the local homology algorithm of Smith and Waterman Add. APL. Math. 2:482 (1981), by the homology alignment algorithm of Needleman and Wunsch J. Mol. Biol. 48:443 (1970), by the search for similarity method of Pearson and Lipman Proc. Natl. Acad. Sci. (USA) 85: 2444 (1988), by computerized implementations of these algorithms (GAP, BESTFIT, BLAST, PASTA, and TFASTA in the Wisconsin Genetics Software Package, Genetics Computer Group (GCG), 575 Science Dr., Madison, Wis.), or by inspection. Given that two sequences have been identified for comparison, GAP and BESTFIT are preferably employed to determine their optimal alignment. Typically, the default values of 5.00 for gap weight and 0.30 for gap weight length are used.

Plant Promoter: A "plant promoter" is a promoter capable of initiating transcription in plant cells and can modulate transcription of a polynucleotide. Such promoters need not be of plant origin. For example, promoters derived from plant viruses, such as the CaMV35S promoter or from *Agrobacterium tumefaciens* such as the T-DNA promoters, can be plant promoters. A typical example of a plant promoter of plant origin is the maize ubiquitin-1 (ubi-1) promoter known to those of skill.

Plant Tissue: The term "plant tissue" includes differentiated and undifferentiated tissues or plants, including but not limited to roots, stems, shoots, cotyledons, epicotyl, hypocotyl, leaves, pollen, seeds, tumor tissue and various forms of cells in culture such as single cells, protoplast, embryos, and callus tissue. The plant tissue may be in plants or in organ, tissue or cell culture.

Preferential Transcription: "Preferential transcription" is defined as transcription that occurs in a particular pattern of cell types or developmental times or in response to specific stimuli or combination thereof. Non-limitive examples of preferential transcription include: high transcript levels of a desired sequence in root tissues; detectable transcript levels of a desired sequence in certain cell types during embryogenesis; and low transcript levels of a desired sequence under drought conditions. Such preferential transcription can be determined by measuring initiation, rate, and/or levels of transcription.

Promoter: A "promoter" is a DNA sequence that directs the transcription of a polynucleotide. Typically a promoter is located in the 5' region of a polynucleotide to be transcribed, proximal to the transcriptional start site of such polynucleotide. More typically, promoters are defined as the region upstream of the first exon; more typically, as a region upstream of the first of multiple transcription start sites; more typically, as the region downstream of the preceding gene and upstream of the first of multiple transcription start sites; more typically, the region downstream of the polyA signal and upstream of the first of multiple transcription start sites; even more typically, about 3,000 nucleotides upstream of the ATG of the first exon; even more typically, 2,000 nucleotides upstream of the first of multiple transcription start sites. The promoters of the invention comprise at least a core promoter as defined above. Frequently promoters are capable of directing transcription of genes located on each of the complementary DNA strands that are 3' to the promoter. Stated differently, many promoters exhibit bidirectionality and can direct transcription of a downstream gene when present in either orientation (i.e. 5' to 3' or 3' to 5' relative to the coding region of the gene). Additionally, the promoter may also include at least one control element such as an upstream element. Such elements include UARs and optionally, other DNA sequences that affect transcription of a polynucleotide such as a synthetic upstream element.

Promoter Control Element: The term "promoter control element" as used herein describes elements that influence the activity of the promoter. Promoter control elements include transcriptional regulatory sequence determinants such as, but not limited to, enhancers, scaffold/matrix attachment regions, TATA boxes, transcription start locus control regions, UARs, URRs, other transcription factor binding sites and inverted repeats.

Public sequence: The term "public sequence," as used in the context of the instant application, refers to any sequence that has been deposited in a publicly accessible database prior to the filing date of the present application. This term encompasses both amino acid and nucleotide sequences. Such sequences are publicly accessible, for example, on the BLAST databases on the NCBI FTP web site (accessible at ncbi.nlm.nih.gov/ftp). The database at the NCBI FTP site utilizes "gi" numbers assigned by NCBI as a unique identifier for each sequence in the databases, thereby providing a non-redundant database for sequence from various databases, including GenBank, EMBL, DBBJ, (DNA Database of Japan) and PDB (Brookhaven Protein Data Bank).

Regulatory Sequence: The term "regulatory sequence," as used in the current invention, refers to any nucleotide sequence that influences transcription or translation initiation and rate, or stability and/or mobility of a transcript or polypeptide product. Regulatory sequences include, but are not limited to, promoters, promoter control elements, protein binding sequences, 5' and 3' UTRs, transcriptional start sites, termination sequences, polyadenylation sequences, introns, certain sequences within amino acid coding sequences such as secretory signals, protease cleavage sites, etc.

Related Sequences: "Related sequences" refer to either a polypeptide or a nucleotide sequence that exhibits some degree of sequence similarity with a reference sequence.

Specific Promoters: In the context of the current invention, "specific promoters" refers to a subset of promoters that have a high preference for modulating transcript levels in a specific tissue or organ or cell and/or at a specific time during development of an organism. By "high preference" is meant at least 3-fold, preferably 5-fold, more preferably at least 10-fold still more preferably at least 20-fold, 50-fold or 100-fold increase in transcript levels under the specific condition over the transcription under any other reference condition considered. Typical examples of temporal and/or tissue or organ specific promoters of plant origin that can be used with the polynucleotides of the present invention, are: PTA29, a promoter which is capable of driving gene transcription specifically in tapetum and only during anther development (Koltonow et al., Plant Cell 2:1201 (1990); RCc2 and RCc3, promoters that direct root-specific gene transcription in rice (Xu et al., Plant Mol. Biol. 27:237 (1995); TobRB27, a root-specific promoter from tobacco (Yamamoto et al., Plant Cell 3:371 (1991)). Examples of tissue-specific promoters under developmental control include promoters that initiate transcription only in certain tissues or organs, such as root, ovule, fruit, seeds, or flowers. Other specific promoters include those from genes encoding seed storage proteins or the lipid body membrane protein, oleosin. A few root-specific promoters are noted above. See also "Preferential transcription".

Stringency: "Stringency" as used herein is a function of probe length, probe composition (G+C content), and salt concentration, organic solvent concentration, and temperature of hybridization or wash conditions. Stringency is typically compared by the parameter $T_m$, which is the temperature at which 50% of the complementary molecules in the hybridization are hybridized, in terms of a temperature differential from $T_m$. High stringency conditions are those providing a condition of $T_m-5°$ C. to $T_m-10°$ C. Medium or moderate stringency conditions are those providing $T_m-20°$ C. to $T_m-29°$ C. Low stringency conditions are those providing a condition of $T_m-40°$ C. to $T_m-48°$ C. The relationship of hybridization conditions to $T_m$ (in ° C.) is expressed in the mathematical equation $$T_m = 81.5 - 16.6(\log_{10}[Na^+]) + 0.41(\% \ G+C) - (600/N) \quad (1)$$

where N is the length of the probe. This equation works well for probes 14 to 70 nucleotides in length that are identical to the target sequence. The equation below for $T_m$ of DNA-DNA hybrids is useful for probes in the range of 50 to greater than 500 nucleotides, and for conditions that include an organic solvent (formamide).

$$T_m = 81.5 + 16.6 \log\{[Na^+]/(1+0.7[Na^+])\} + 0.41(\% \ G+C) - 500/L \ 0.63(\% \ \text{formamide}) \quad (2)$$

where L is the length of the probe in the hybrid. (P. Tijessen, "Hybridization with Nucleic Acid Probes" in *Laboratory Techniques in Biochemistry and Molecular Biology*, P. C. vand der Vliet, ed., c. 1993 by Elsevier, Amsterdam.) The $T_m$ of equation (2) is affected by the nature of the hybrid; for DNA-RNA hybrids $T_m$ is 10-15° C. higher than calculated, for RNA-RNA hybrids $T_m$ is 20-25° C. higher. Because the $T_m$ decreases about 1° C. for each 1% decrease in homology when a long probe is used (Bonner et al., J. Mol. Biol. 81:123 (1973)), stringency conditions can be adjusted to favor detection of identical genes or related family members.

Equation (2) is derived assuming equilibrium and therefore, hybridizations according to the present invention are most preferably performed under conditions of probe excess and for sufficient time to achieve equilibrium. The time required to reach equilibrium can be shortened by inclusion of a hybridization accelerator such as dextran sulfate or another high volume polymer in the hybridization buffer.

Stringency can be controlled during the hybridization reaction or after hybridization has occurred by altering the salt and temperature conditions of the wash solutions used. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

Substantially free of: A composition containing A is "substantially free of" B when at least 85% by weight of the total A+B in the composition is A. Preferably, A comprises at least about 90% by weight of the total of A+B in the composition, more preferably at least about 95% or even 99% by weight. For example, a plant gene can be substantially free of other plant genes. Other examples include, but are not limited to, ligands substantially free of receptors (and vice versa), a growth factor substantially free of other growth factors and a transcription binding factor substantially free of nucleic acids.

Suppressor: See "Enhancer/Suppressor"

TATA to start: "TATA to start" shall mean the distance, in number of nucleotides, between the primary TATA motif and the start of transcription.

Transgenic plant: A "transgenic plant" is a plant having one or more plant cells that contain at least one exogenous polynucleotide introduced by recombinant nucleic acid methods.

Translational start site: In the context of the present invention, a "translational start site" is usually an ATG or AUG in a transcript, often the first ATG or AUG. A single protein encoding transcript, however, may have multiple translational start sites.

Transcription start site: "Transcription start site" is used in the current invention to describe the point at which transcription is initiated. This point is typically located about 25 nucleotides downstream from a TFIID binding site, such as a TATA box. Transcription can initiate at one or more sites within the gene, and a single polynucleotide to be transcribed may have multiple transcriptional start sites, some of which may be specific for transcription in a particular cell-type or tissue or organ. "+1" is stated relative to the transcription start site and indicates the first nucleotide in a transcript.

Upstream Activating Region (UAR): An "Upstream Activating Region" or "UAR" is a position or orientation dependent nucleic acid element that primarily directs tissue, organ, cell type, or environmental regulation of transcript level, usually by affecting the rate of transcription initiation. Corresponding DNA elements that have a transcription inhibitory effect are called herein "Upstream Repressor Regions" or "URR"s. The essential activity of these elements is to bind a protein factor. Such binding can be assayed by methods described below. The binding is typically in a manner that influences the steady state level of a transcript in a cell or in vitro transcription extract.

Untranslated region (UTR): A "UTR" is any contiguous series of nucleotide bases that is transcribed, but is not translated. A 5' UTR lies between the start site of the transcript and the translation initiation codon and includes the +1 nucleotide. A 3' UTR lies between the translation termination codon and the end of the transcript. UTRs can have particular functions such as increasing mRNA message stability or translation attenuation. Examples of 3' UTRs include, but are not limited to polyadenylation signals and transcription termination sequences.

Variant: The term "variant" is used herein to denote a polypeptide or protein or polynucleotide molecule that differs from others of its kind in some way. For example, polypeptide and protein variants can consist of changes in amino acid sequence and/or charge and/or post-translational modifications (such as glycosylation, etc). Likewise, polynucleotide variants can consist of changes that add or delete a specific UTR or exon sequence. It will be understood that there may be sequence variations within sequence or fragments used or disclosed in this application. Preferably, variants will be such that the sequences have at least 80%, preferably at least 90%, 95, 97, 98, or 99% sequence identity. Variants preferably measure the primary biological function of the native polypeptide or protein or polynucleotide.

2. Introduction

The polynucleotides of the invention comprise promoters and promoter control elements that are capable of modulating transcription.

Such promoters and promoter control elements can be used in combination with native or heterologous promoter fragments, control elements or other regulatory sequences to modulate transcription and/or translation.

Specifically, promoters and control elements of the invention can be used to modulate transcription of a desired polynucleotide, which includes without limitation:

(a) antisense;

(b) ribozymes;

(c) coding sequences; or (d) fragments thereof.

The promoter also can modulate transcription in a host genome in cis- or in trans-.

In an organism, such as a plant, the promoters and promoter control elements of the instant invention are useful to produce preferential transcription which results in a desired pattern of transcript levels in a particular cells, tissues, or organs, or under particular conditions.

3. Table of Contents

The following description of the present invention is outlined in the following table of contents.

| | |
|---|---|
| A. | Identifying and Isolating Promoter Sequences of the Invention |
| | (1) Cloning Methods |
| | (2) Chemical Synthesis |
| B. | Generating a "core" promoter sequence |
| C. | Isolating Related Promoter Sequences |
| | (1) Relatives Based on Nucleotide Sequence Identity |
| | (2) Relatives Based on Coding Sequence Identity |
| | (3) Relatives based on Common Function |
| D. | Identifying Control Elements |
| | (1) Types of Transcription Control Elements |
| | (2) Those Described by the Examples |
| | (3) Those Identifiable by Bioinformatics |
| | (4) Those Identifiable by In Vitro and In Vivo Assays |
| | (5) Non-Natural Control Elements |
| E. | Constructing Promoters and Control Elements |
| | (1) Combining Promoters and Promoter Control Elements |
| | (2) Number of Promoter Control Elements |
| | (3) Spacing Between Control Elements |
| F. | Vectors |
| | (1) Modification of Transcription by Promoters and Promoter Control Elements |
| | (2) Polynucleotide to be Transcribed |
| | (3) Other Regulatory Elements |
| | (4) Other Components of Vectors |
| G. | Insertion of Polynucleotides and Vectors Into a Host Cell |
| | (1) Autonomous of the Host Genome |
| | (2) Integrated into the Host Genome |
| H. | Utility |

A. Identifying and Isolating Promoter Sequences of the Invention

The promoters and promoter control elements of the present invention are presented in Table 1 in the section entitled "The predicted promoter" sequence and were identified from *Arabidopsis thaliana* or *Oryza sativa*. Additional promoter sequences encompassed by the invention can be identified as described below.

(1) Cloning Methods

Isolation from genomic libraries of polynucleotides comprising the sequences of the promoters and promoter control elements of the present invention is possible using known techniques.

For example, polymerase chain reaction (PCR) can amplify the desired polynucleotides utilizing primers designed from sequences in the row titled "The spatial expression of the promoter-marker-vector". Polynucleotide libraries comprising genomic sequences can be constructed according to Sambrook et al., *Molecular Cloning: A Laboratory Manual*, $2^{nd}$ Ed. (1989) Cold Spring Harbor Press, Cold Spring Harbor, N.Y.), for example.

Other procedures for isolating polynucleotides comprising the promoter sequences of the invention include, without limitation, tail-PCR, and 5' rapid amplification of cDNA ends (RACE). See, for tail-PCR, for example, Liu et al., *Plant J* 8(3): 457-463 (September, 1995); Liu et al., *Genomics* 25: 674-681 (1995); Liu et al., *Nucl. Acids Res.* 21(14): 3333-3334 (1993); and Zoe et al., *BioTechniques* 27(2): 240-248 (1999); for RACE, see, for example, *PCR Protocols: A Guide to Methods and Applications*, (1990) Academic Press, Inc.

(2) Chemical Synthesis

In addition, the promoters and promoter control elements described in Table 1 in the section entitled "The predicted promoter" sequence can be chemically synthesized according to techniques in common use. See, for example, Beaucage et al., *Tet. Lett.* (1981) 22: 1859 and U.S. Pat. No. 4,668,777.

Such chemical oligonucleotide synthesis can be carried out using commercially available devices, such as, Biosearch 4600 or 8600 DNA synthesizer, by Applied Biosystems, a division of Perkin-Elmer Corp., Foster City, Calif., USA; and Expedite by Perceptive Biosystems, Framingham, Mass., USA.

Synthetic RNA, including natural and/or analog building blocks, can be synthesized on the Biosearch 8600 machines, see above.

Oligonucleotides can be synthesized and then ligated together to construct the desired polynucleotide.

B. Generating Reduced and "Core" Promoter Sequences

Included in the present invention are reduced and "core" promoter sequences. The reduced promoters can be isolated from the promoters of the invention by deleting at least one 5' UTR, exon or 3' UTR sequence present in the promoter sequence that is associated with a gene or coding region located 5' to the promoter sequence or in the promoter's endogenous coding region.

Similarly, the "core" promoter sequences can be generated by deleting all 5' UTRs, exons and 3' UTRs present in the promoter sequence and the associated intervening sequences that are related to the gene or coding region 5' to the promoter region and the promoter's endogenous coding region.

This data is presented in the row titled "Optional Promoter Fragments".

C. Isolating Related Promoter Sequences

Included in the present invention are promoter and promoter control elements that are related to those described in Table 1 in the section entitled "The predicted promoter sequence". Such related sequence can be isolated utilizing (a) nucleotide sequence identity;
(b) coding sequence identity; or
(c) common function or gene products.

Relatives can include both naturally occurring promoters and non-natural promoter sequences. Non-natural related promoters include nucleotide substitutions, insertions or deletions of naturally-occurring promoter sequences that do not substantially affect transcription modulation activity. For example, the binding of relevant DNA binding proteins can still occur with the non-natural promoter sequences and promoter control elements of the present invention.

According to current knowledge, promoter sequences and promoter control elements exist as functionally important regions, such as protein binding sites, and spacer regions. These spacer regions are apparently required for proper positioning of the protein binding sites. Thus, nucleotide substitutions, insertions and deletions can be tolerated in these spacer regions to a certain degree without loss of function.

In contrast, less variation is permissible in the functionally important regions, since changes in the sequence can interfere with protein binding. Nonetheless, some variation in the functionally important regions is permissible so long as function is conserved.

The effects of substitutions, insertions and deletions to the promoter sequences or promoter control elements may be to increase or decrease the binding of relevant DNA binding proteins to modulate transcript levels of a polynucleotide to be transcribed. Effects may include tissue-specific or condition-specific modulation of transcript levels of the polypeptide to be transcribed. Polynucleotides representing changes to the nucleotide sequence of the DNA-protein contact region by insertion of additional nucleotides, changes to identity of relevant nucleotides, including use of chemically-modified bases, or deletion of one or more nucleotides are considered encompassed by the present invention.

(1) Relatives Based on Nucleotide Sequence Identity

Included in the present invention are promoters exhibiting nucleotide sequence identity to those described in Table 1 in the section entitled "The predicted promoter sequence".

Definition

Typically, such related promoters exhibit at least 80% sequence identity, preferably at least 85%, more preferably at least 90%, and most preferably at least 95%, even more preferably, at least 96%, 97%, 98% or 99% sequence identity compared to those shown in Table 1 in the section entitled "The predicted promoter" sequence. Such sequence identity can be calculated by the algorithms and computers programs described above.

Usually, such sequence identity is exhibited in an alignment region that is at least 75% of the length of a sequence shown in Table 1 in the section entitled "The predicted promoter" sequence or corresponding full-length sequence; more usually at least 80%; more usually, at least 85%, more usually at least 90%, and most usually at least 95%, even more usually, at least 96%, 97%, 98% or 99% of the length of a sequence shown in Table 1 in the section entitled "The predicted promoter sequence".

The percentage of the alignment length is calculated by counting the number of residues of the sequence in region of strongest alignment, e.g., a continuous region of the sequence that contains the greatest number of residues that are identical to the residues between two sequences that are being aligned. The number of residues in the region of strongest alignment is divided by the total residue length of a sequence in Table 1 in the section entitled "The predicted promoter sequence".

These related promoters may exhibit similar preferential transcription as those promoters described in Table 1 in the section entitled "The predicted promoter sequence".

Construction of Polynucleotides

Naturally occurring promoters that exhibit nucleotide sequence identity to those shown in Table 1 in the section entitled "The predicted promoter sequence" can be isolated using the techniques as described above. More specifically, such related promoters can be identified by varying stringencies, as defined above, in typical hybridization procedures such as Southern blots or probing of polynucleotide libraries, for example.

Non-natural promoter variants of those shown in Table 1 can be constructed using cloning methods that incorporate the desired nucleotide variation. See, for example, Ho, S. N., et al. Gene 77:51-59 1989, describing a procedure site directed mutagenesis using PCR.

Any related promoter showing sequence identity to those shown in Table can be chemically synthesized as described above.

Also, the present invention includes non-natural promoters that exhibit the above-sequence identity to those in Table 1.

The promoters and promoter control elements of the present invention may also be synthesized with 5' or 3' extensions, to facilitate additional manipulation, for instance.

The present invention also includes reduced promoter sequences. These sequences have at least one of the optional promoter fragments deleted.

Core promoter sequences are another embodiment of the present invention. The core promoter sequences have all of the optional promoter fragments deleted.

Testing of Polynucleotides

Polynucleotides of the invention were tested for activity by cloning the sequence into an appropriate vector, transforming plants with the construct and assaying for marker gene expression. Recombinant DNA constructs were prepared which comprise the polynucleotide sequences of the invention inserted into a vector suitable for transformation of plant cells. The construct can be made using standard recombinant DNA techniques (Sambrook et al. 1989) and can be introduced to the species of interest by *Agrobacterium*-mediated transformation or by other means of transformation as referenced below.

The vector backbone can be any of those typical in the art such as plasmids, viruses, artificial chromosomes, BACs, YACs and PACs and vectors of the sort described by
(a) BAC: Shizuya et al., Proc. Natl. Acad. Sci. USA 89: 8794-8797 (1992); Hamilton et al., Proc. Natl. Acad. Sci. USA 93: 9975-9979 (1996);
(b) YAC: Burke et al., Science 236:806-812 (1987);
(c) PAC: Sternberg N. et al., Proc Natl Acad Sci USA. January; 87(1):103-7 (1990);
(d) Bacteria-Yeast Shuttle Vectors: Bradshaw et al., Nucl Acids Res 23: 4850-4856 (1995);
(e) Lambda Phage Vectors: Replacement Vector, e.g., Frischauf et al., J. Mol Biol 170: 827-842 (1983); or Insertion vector, e.g., Huynh et al., In: Glover NM (ed) DNA Cloning: A practical Approach, Vol. 1 Oxford: IRL Press (1985); T-DNA gene fusion vectors:Walden et al., Mol Cell Biol 1: 175-194 (1990); and
(g) Plasmid vectors: Sambrook et al., infra.

Typically, the construct comprises a vector containing a sequence of the present invention operationally linked to any marker gene. The polynucleotide was identified as a promoter by the expression of the marker gene. Although many marker genes can be used, Green Fluorescent Protein (GFP) is preferred. The vector may also comprise a marker gene that confers a selectable phenotype on plant cells. The marker may encode biocide resistance, particularly antibiotic resistance, such as resistance to kanamycin, G418, bleomycin, hygromycin, or herbicide resistance, such as resistance to chlorosulfuron or phosphinotricin. Vectors can also include origins of replication, scaffold attachment regions (SARs), markers, homologous sequences, introns, etc.

Promoter Control Elements of the Invention

The promoter control elements of the present invention include those that comprise a sequence shown in Table 1 in the section entitled "The predicted promoter sequence" and fragments thereof. The size of the fragments of the row titled "The predicted promoter sequence" can range from 5 bases to 10 kilobases (kb). Typically, the fragment size is no smaller than 8 bases; more typically, no smaller than 12; more typically, no smaller than 15 bases; more typically, no smaller than 20 bases; more typically, no smaller than 25 bases; even more typically, no more than 30, 35, 40 or 50 bases.

Usually, the fragment size in no larger than 5 kb bases; more usually, no larger than 2 kb; more usually, no larger than 1 kb; more usually, no larger than 800 bases; more usually, no larger than 500 bases; even more usually, no more than 250, 200, 150 or 100 bases.

Relatives Based on Nucleotide Sequence Identity

Included in the present invention are promoter control elements exhibiting nucleotide sequence identity to those described in Table 1 in the section entitled "The predicted promoter sequence" of fragments thereof.

Typically, such related promoters exhibit at least 80% sequence identity, preferably at least 85%, more preferably at least 90%, and most preferably at least 95%, even more preferably, at least 96%, 97%, 98% or 99% sequence identity compared to those shown in Table 1 in the section entitled "The predicted promoter sequence". Such sequence identity can be calculated by the algorithms and computers programs described above.

Promoter Control Element Configuration

A common configuration of the promoter control elements in RNA polymerase II promoters is shown below:

For more description, see, for example, "Models for prediction and recognition of eukaryotic promoters", T. Werner, Mammalian Genome, 10, 168-175 (1999).

Promoters are generally modular in nature. Promoters can consist of a basal promoter which functions as a site for assembly of a transcription complex comprising an RNA polymerase, for example RNA polymerase II. A typical transcription complex will include additional factors such as $TF_{II}B$, $TF_{II}D$, and $TF_{II}E$. Of these, $TF_{II}D$ appears to be the only one to bind DNA directly. The promoter might also contain one or more promoter control elements such as the elements discussed above. These additional control elements may function as binding sites for additional transcription factors that have the function of modulating the level of transcription with respect to tissue specificity and of transcriptional responses to particular environmental or nutritional factors, and the like.

One type of promoter control element is a polynucleotide sequence representing a binding site for proteins. Typically, within a particular functional module, protein binding sites constitute regions of 5 to 60, preferably 10 to 30, more preferably 10 to 20 nucleotides. Within such binding sites, there are typically 2 to 6 nucleotides which specifically contact amino acids of the nucleic acid binding protein.

The protein binding sites are usually separated from each other by 10 to several hundred nucleotides, typically by 15 to 150 nucleotides, often by 20 to 50 nucleotides.

Further, protein binding sites in promoter control elements often display dyad symmetry in their sequence. Such elements can bind several different proteins, and/or a plurality of sites can bind the same protein. Both types of elements may be combined in a region of 50 to 1,000 base pairs.

Binding sites for any specific factor have been known to occur almost anywhere in a promoter. For example, functional AP-1 binding sites can be located far upstream, as in the rat bone sialoprotein gene, where an AP-1 site located about 900 nucleotides upstream of the transcription start site suppresses expression. Yamauchi et al., Matrix Biol., 15, 119-130 (1996). Alternatively, an AP-1 site located close to the transcription start site plays an important role in the expression of Moloney murine leukemia virus. Sap et al., Nature, 340, 242-244, (1989).

(2) Those Identifiable by Bioinformatics

Promoter control elements from the promoters of the instant invention can be identified utilizing bioinformatic or computer driven techniques.

One method uses a computer program AlignACE to identify regulatory motifs in genes that exhibit common preferential transcription across a number of time points. The program identifies common sequence motifs in such genes. See, Roth et al., Nature Biotechnol. 16: 949-945 (1998); Tavazoie et al., Nat Genet 1999 July; 22(3):281-5;

Genomatix, also makes available a GEMS Launcher program and other programs to identify promoter control elements and configuration of such elements. Genomatix is located in Munich, Germany.

Other references also describe detection of promoter modules by models independent of overall nucleotide sequence similarity. See, for instance, Klingenhoff et al., Bioinformatics 15, 180-186 (1999).

Protein binding sites of promoters can be identified as reported in "Computer-assisted prediction, classification, and delimination of protein binding sites in nucleic acids", Frech, et al., Nucleic Acids Research, Vol. 21, No. 7, 1655-1664, 1993.

Other programs used to identify protein binding sites include, for example, Signal Scan, Prestridge et al., Comput. Appl. Biosci. 12: 157-160 (1996); Matrix Search, Chen et al., Comput. Appl. Biosci. 11: 563-566 (1995), available as part of Signal Scan 4.0; MatInspector, Ghosh et al., Nucl. Acid Res. 21: 3117-3118 (1993) available http://ww.gsf.de/cgi-bin/matsearch.pl; ConsInspector, Frech et al., Nucl. Acids Res. 21: 1655-1664 (1993), available at ftp://ariane.gsf.de/pub/dos; TFSearch; and TESS.

Frech et al., "Software for the analysis of DNA sequence elements of transcription", Bioinformatics & Sequence Analysis, Vol. 13, no. 1, 89-97 (1997) is a review of different software for analysis of promoter control elements. This paper also reports the usefulness of matrix-based approaches to yield more specific results.

For other procedures, see, Fickett et al., Curr. Op. Biotechnol. 11: 19-24 (2000); and Quandt et al., Nucleic Acids Res., 23, 4878-4884 (1995).

(3) Those Identifiable by In-Vitro and In-Vivo Assays

Promoter control elements also can be identified with in-vitro assays, such as transcription detection methods; and with in-vivo assays, such as enhancer trapping protocols.

In-Vitro Assays

Examples of in-vitro assays include detection of binding of protein factors that bind promoter control elements. Fragments of the instant promoters can be used to identify the location of promoter control elements. Another option for obtaining a promoter control element with desired properties is to modify known promoter sequences. This is based on the fact that the function of a promoter is dependent on the interplay of regulatory proteins that bind to specific, discrete nucleotide sequences in the promoter, termed motifs. Such interplay subsequently affects the general transcription machinery and regulates transcription efficiency. These proteins are positive regulators or negative regulators (repressors), and one protein can have a dual role depending on the context (Johnson, P. F. and McKnight, S. L. Annu. Rev. Biochem. 58:799-839 (1989)).

One type of in-vitro assay utilizes a known DNA binding factor to isolate DNA fragments that bind. If a fragment or promoter variant does not bind, then a promoter control element has been removed or disrupted. For specific assays, see, for instance, B. Luo et al., J. Mol. Biol. 266:470 (1997), S. Chusacultanachai et al., J. Biol. Chem. 274:23591 (1999), D. Fabbro et al., Biochem. Biophys. Res. Comm. 213:781 (1995)).

Alternatively, a fragment of DNA suspected of conferring a particular pattern of specificity can be examined for activity in binding transcription factors involved in that specificity by methods such as DNA footprinting (e.g. D. J. Cousins et al., Immunology 99:101 (2000); V. Kolla et a., Biochem. Biophys. Res. Comm. 266:5 (1999)) or "mobility-shift" assays (E. D. Fabiani et al., J. Biochem. 347:147 (2000); N. Sugiura et al., J. Biochem 347:155 (2000)) or fluorescence polarization (e.g. Royer et al., U.S. Pat. No. 5,445,935). Both mobility shift and DNA footprinting assays can also be used to identify portions of large DNA fragments that are bound by proteins in unpurified transcription extracts prepared from tissues or organs of interest.

Cell-free transcription extracts can be prepared and used to directly assay in a reconstitutable system (Narayan et al., Biochemistry 39:818 (2000)).

In-Vivo Assays

Promoter control elements can be identified with reporter genes in in-vivo assays with the use of fragments of the instant promoters or variants of the instant promoter polynucleotides.

For example, various fragments can be inserted into a vector, comprising a basal or "core" promoter, for example, operably linked to a reporter sequence, which, when transcribed, can produce a detectable label. Examples of reporter genes include those encoding luciferase, green fluorescent protein, GUS, neo, cat and bar. Alternatively, reporter sequence can be detected utilizing AFLP and microarray techniques.

In promoter probe vector systems, genomic DNA fragments are inserted upstream of the coding sequence of a reporter gene that is expressed only when the cloned fragment contains DNA having transcription modulation activity (Neve, R. L. et al., Nature 277:324-325 (1979)). Control elements are disrupted when fragments or variants lacking any transcription modulation activity. Probe vectors have been designed for assaying transcription modulation in E. coli (An, G. et al., J. Bact. 140:400-407 (1979)) and other bacterial hosts (Band, L. et al., Gene 26:313-315 (1983); Achen, M. G., Gene 45:45-49 (1986)), yeast (Goodey, A. R. et al., Mol. Gen. Genet. 204:505-511 (1986)) and mammalian cells (Pater, M. M. et al., J. Mol. App. Gen. 2:363-371 (1984)).

A different design of a promoter/control element trap includes packaging into retroviruses for more efficient delivery into cells. One type of retroviral enhancer trap was described by von Melchner et al. (Genes Dev. 1992; U.S. Pat. No. 5,364,783). The basic design of this vector includes a reporter protein coding sequence engineered into the U3 portion of the 3' LTR. No splice acceptor consensus sequences are included, limiting its utility to work as an enhancer trap only. A different approach to a gene trap using retroviral vectors was pursued by Friedrich and Soriano (Genes Dev. 1991), who engineered a lacZ-neo fusion protein linked to a splicing acceptor. LacZ-neo fusion protein expression from trapped loci allows not only for drug selection, but also for visualization of β-galatactosidase expression using the chromogenic substrate, X-gal.

A general review of tools for identifying transcriptional regulatory regions of genomic DNA is provided by J. W. Fickett et al. (Curr. Opn. Biotechnol. 11:19 (2000).

(4) Non-Natural Control Elements

Non-natural control elements can be constructed by inserting, deleting or substituting nucleotides into the promoter control elements described above. Such control elements are capable of transcription modulation that can be determined using any of the assays described above.

D. Constructing Promoters with Control Elements (1) Combining Promoters and Promoter Control Elements The promoter polynucleotides and promoter control elements of the present invention, both naturally occurring and synthetic, can be combined with each other to produce the desired preferential transcription. Also, the polynucleotides of the invention can be combined with other known sequences to obtain other useful promoters to modulate, for example, tissue transcription specific or transcription specific to certain conditions. Such preferential transcription can be determined using the techniques or assays described above.

Fragments, variants, as well as full-length sequences those shown in Table 1 in the section entitled "The predicted promoter sequence" and relatives are useful alone or in combination.

The location and relation of promoter control elements within a promoter can affect the ability of the promoter to modulate transcription. The order and spacing of control elements is a factor when constructing promoters.

(2) Number of Promoter Control Elements

Promoters can contain any number of control elements. For example, a promoter can contain multiple transcription binding sites or other control elements. One element may confer tissue or organ specificity; another element may limit transcription to specific time periods, etc. Typically, promoters will contain at least a basal or core promoter as described above. Any additional element can be included as desired. For example, a fragment comprising a basal or "core" promoter can be fused with another fragment with any number of additional control elements.

(3) Spacing Between Control Elements

Spacing between control elements or the configuration or control elements can be determined or optimized to permit the desired protein-polynucleotide or polynucleotide interactions to occur.

For example, if two transcription factors bind to a promoter simultaneously or relatively close in time, the binding sites are spaced to allow each factor to bind without steric hinderance. The spacing between two such hybridizing control elements can be as small as a profile of a protein bound to a control element. In some cases, two protein binding sites can be adjacent to each other when the proteins bind at different times during the transcription process.

Further, when two control elements hybridize the spacing between such elements will be sufficient to allow the promoter polynucleotide to hairpin or loop to permit the two elements to bind. The spacing between two such hybridizing control elements can be as small as a t-RNA loop, to as large as 10 kb.

Typically, the spacing is no smaller than 5 bases; more typically, no smaller than 8; more typically, no smaller than 15 bases; more typically, no smaller than 20 bases; more typically, no smaller than 25 bases; even more typically, no more than 30, 35, 40 or 50 bases.

Usually, the fragment size in no larger than 5 kb bases; more usually, no larger than 2 kb; more usually, no larger than 1 kb; more usually, no larger than 800 bases; more usually, no larger than 500 bases; even more usually, no more than 250, 200, 150 or 100 bases.

Such spacing between promoter control elements can be determined using the techniques and assays described above.

(4) Other Promoters

The following are promoters that are induced under stress conditions and can be combined with those of the present invention: ldh1 (oxygen stress; tomato; see Germain and Ricard. 1997. Plant Mol Biol 35:949-54), GPx and CAT (oxygen stress; mouse; see Franco et al. 1999. Free Radic Biol Med 27:1122-32), ci7 (cold stress; potato; see Kirch et al. 1997. Plant Mol Biol. 33:897-909), Bz2 (heavy metals; maize; see Marrs and Walbot. 1997. Plant Physiol 113:93-102), HSP32 (hyperthermia; rat; see Raju and Maines. 1994. Biochim Biophys Acta 1217:273-80); MAPKAPK-2 (heat shock; *Drosophila*; see Larochelle and Suter. 1995. Gene 163:209-14).

In addition, the following examples of promoters are induced by the presence or absence of light can be used in combination with those of the present invention: Topoisomerase II (pea; see Reddy et al. 1999. Plant Mol Biol 41:125-37), chalcone synthase (soybean; see Wingender et al. 1989. Mol Gen Genet 218:315-22) mdm2 gene (human tumor; see Saucedo et al. 1998. Cell Growth Differ 9:119-30), Clock and BMAL1 (rat; see Namihira et al. 1999. Neurosci Lett 271:1-4, PHYA (*Arabidopsis*; see Canton and Quail 1999. Plant Physiol 121:1207-16), PRB-1b (tobacco; see Sessa et al. 1995. Plant Mol Biol 28:537-47) and Ypr10 (common bean; see Walter et al. 1996. Eur J Biochem 239:281-93).

The promoters and control elements of the following genes can be used in combination with the present invention to confer tissue specificity: MipB (iceplant; Yamada et al. 1995. Plant Cell 7:1129-42) and SUCS (root nodules; broadbean; Kuster et al. 1993. Mol Plant Microbe Interact 6:507-14) for roots, OsSUT1 (rice; Hirose et al. 1997. Plant Cell Physiol 38:1389-96) for leaves, Msg (soybean; Stomvik et al. 1999. Plant Mol Biol 41:217-31) for siliques, cell (*Arabidopsis*; Shani et al. 1997. Plant Mol Biol 34(6):837-42) and ACT11 (*Arabidopsis*; Huang et al. 1997. Plant Mol Biol 33:125-39) for inflorescence.

Still other promoters are affected by hormones or participate in specific physiological processes, which can be used in combination with those of present invention. Some examples are the ACC synthase gene that is induced differently by ethylene and brassinosteroids (mung bean; Yi et al. 1999. Plant Mol Biol 41:443-54), the TAPG1 gene that is active during abscission (tomato; Kalaitzis et al. 1995. Plant Mol Biol 28:647-56), and the 1-aminocyclopropane-1-carboxylate synthase gene (carnation; Jones et al. 19951 Plant Mol Biol 28:505-12) and the CP-2/cathepsin L gene (rat; Kim and Wright. 1997. Biol Reprod 57:1467-77), both active during senescence.

E. Vectors

Vectors are a useful component of the present invention. In particular, the present promoters and/or promoter control elements may be delivered to a system such as a cell by way of a vector. For the purposes of this invention, such delivery may range from simply introducing the promoter or promoter control element by itself randomly into a cell to integration of a cloning vector containing the present promoter or promoter control element. Thus, a vector need not be limited to a DNA molecule such as a plasmid, cosmid or bacterial phage that has the capability of replicating autonomously in a host cell. All other manner of delivery of the promoters and promoter control elements of the invention are envisioned. The various T-DNA vector types are a preferred vector for use with the present invention. Many useful vectors are commercially available.

It may also be useful to attach a marker sequence to the present promoter and promoter control element in order to determine activity of such sequences. Marker sequences typically include genes that provide antibiotic resistance, such as tetracycline resistance, hygromycin resistance or ampicillin resistance, or provide herbicide resistance. Specific selectable marker genes may be used to confer resistance to herbicides such as glyphosate, glufosinate or broxynil (Comai et al., Nature 317: 741-744 (1985); Gordon-Kamm et al., Plant Cell 2: 603-618 (1990); and Stalker et al., Science 242: 419-423 (1988)). Other marker genes exist which provide hormone responsiveness.

(1) Modification of Transcription by Promoters and Promoter Control Elements

The promoter or promoter control element of the present invention may be operably linked to a polynucleotide to be transcribed. In this manner, the promoter or promoter control element may modify transcription by modulate transcript levels of that polynucleotide when inserted into a genome.

However, prior to insertion into a genome, the promoter or promoter control element need not be linked, operably or otherwise, to a polynucleotide to be transcribed. For example, the promoter or promoter control element may be inserted alone into the genome in front of a polynucleotide already present in the genome. In this manner, the promoter or promoter control element may modulate the transcription of a polynucleotide that was already present in the genome. This polynucleotide may be native to the genome or inserted at an earlier time.

Alternatively, the promoter or promoter control element may be inserted into a genome alone to modulate transcription. See, for example, Vaucheret, H et al. (1998) *Plant J* 16: 651-659. Rather, the promoter or promoter control element may be simply inserted into a genome or maintained extrachromosomally as a way to divert transcription resources of the system to itself. This approach may be used to downregulate the transcript levels of a group of polynucleotide(s).

(2) Polynucleotide to be Transcribed

The nature of the polynucleotide to be transcribed is not limited. Specifically, the polynucleotide may include sequences that will have activity as RNA as well as sequences that result in a polypeptide product. These sequences may include, but are not limited to antisense sequences, ribozyme sequences, spliceosomes, amino acid coding sequences, and fragments thereof.

Specific coding sequences may include, but are not limited to endogenous proteins or fragments thereof, or heterologous proteins including marker genes or fragments thereof.

Promoters and control elements of the present invention are useful for modulating metabolic or catabolic processes. Such processes include, but are not limited to, secondary product metabolism, amino acid synthesis, seed protein storage, oil development, pest defense and nitrogen usage. Some examples of genes, transcripts and peptides or polypeptides participating in these processes, which can be modulated by the present invention: are tryptophan decarboxylase (tdc) and strictosidine synthase (str1), dihydrodipicolinate synthase (DHDPS) and aspartate kinase (AK), 2S albumin and alpha-, beta-, and gamma-zeins, ricinoleate and 3-ketoacyl-ACP synthase (KAS), *Bacillus thuringiensis* (Bt) insecticidal protein, cowpea trypsin inhibitor (CpTI), asparagine synthetase and nitrite reductase. Alternatively, expression constructs can be used to inhibit expression of these peptides and polypeptides by incorporating the promoters in constructs for antisense use, co-suppression use or for the production of dominant negative mutations.

(3) Other Regulatory Elements

As explained above, several types of regulatory elements exist concerning transcription regulation. Each of these regulatory elements may be combined with the present vector if desired.

(4) Other Components of Vectors

Translation of eukaryotic mRNA is often initiated at the codon that encodes the first methionine. Thus, when constructing a recombinant polynucleotide according to the present invention for expressing a protein product, it is preferable to ensure that the linkage between the 3' portion, preferably including the TATA box, of the promoter and the polynucleotide to be transcribed, or a functional derivative thereof, does not contain any intervening codons which are capable of encoding a methionine.

The vector of the present invention may contain additional components. For example, an origin of replication allows for replication of the vector in a host cell. Additionally, homologous sequences flanking a specific sequence allows for specific recombination of the specific sequence at a desired location in the target genome. T-DNA sequences also allow for insertion of a specific sequence randomly into a target genome.

The vector may also be provided with a plurality of restriction sites for insertion of a polynucleotide to be transcribed as well as the promoter and/or promoter control elements of the present invention. The vector may additionally contain selectable marker genes. The vector may also contain a transcriptional and translational initiation region, and a transcriptional and translational termination region functional in the host cell. The termination region may be native with the transcriptional initiation region, may be native with the polynucleotide to be transcribed, or may be derived from another source. Convenient termination regions are available from the Ti-plasmid of *A. tumefaciens*, such as the octopine synthase and nopaline synthase termination regions. See also, Guerineau et al., (1991) Mol. Gen. Genet. 262:141-144; Proudfoot (1991) Cell 64:671-674; Sanfacon et al. (1991) Genes Dev. 5:141-149; Mogen et al. (1990) Plant Cell 2:1261-1272; Munroe et al. (1990) Gene 91:151-158; Ballas et al. 1989) Nucleic Acids Res. 17:7891-7903; Joshi et al. (1987) Nucleic Acid Res. 15:9627-9639.

Where appropriate, the polynucleotide to be transcribed may be optimized for increased expression in a certain host cell. For example, the polynucleotide can be synthesized using preferred codons for improved transcription and translation. See U.S. Pat. Nos. 5,380,831, 5,436,391; see also and Murray et al., (1989) Nucleic Acids Res. 17:477-498.

Additional sequence modifications include elimination of sequences encoding spurious polyadenylation signals, exon intron splice site signals, transposon-like repeats, and other such sequences well characterized as deleterious to expression. The G-C content of the polynucleotide may be adjusted to levels average for a given cellular host, as calculated by reference to known genes expressed in the host cell. The polynucleotide sequence may be modified to avoid hairpin secondary mRNA structures.

A general description of expression vectors and reporter genes can be found in Gruber, et al., "Vectors for Plant Transformation, in Methods in Plant Molecular Biology & Biotechnology" in Glich et al., (Eds. pp. 89-119, CRC Press, 1993). Moreover GUS expression vectors and GUS gene cassettes are available from Clonetech Laboratories, Inc., Palo Alto, Calif. while luciferase expression vectors and luciferase gene cassettes are available from Promega Corp. (Madison, Wis.). GFP vectors are available from Aurora Biosciences.

F. Polynucleotide Insertion into a Host Cell

The polynucleotides according to the present invention can be inserted into a host cell. A host cell includes but is not limited to a plant, mammalian, insect, yeast, and prokaryotic cell, preferably a plant cell.

The method of insertion into the host cell genome is chosen based on convenience. For example, the insertion into the host cell genome may either be accomplished by vectors that integrate into the host cell genome or by vectors which exist independent of the host cell genome.

(1) Polynucleotides Autonomous of the Host Genome

The polynucleotides of the present invention can exist autonomously or independent of the host cell genome. Vectors of these types are known in the art and include, for example, certain type of non-integrating viral vectors, autonomously replicating plasmids, artificial chromosomes, and the like.

Additionally, in some cases transient expression of a polynucleotide may be desired.

(2) Polynucleotides Integrated into the Host Genome

The promoter sequences, promoter control elements or vectors of the present invention may be transformed into host cells. These transformations may be into protoplasts or intact tissues or isolated cells. Preferably expression vectors are introduced into intact tissue. General methods of culturing plant tissues are provided for example by Maki et al. "Procedures for Introducing Foreign DNA into Plants" in Methods in Plant Molecular Biology & Biotechnology, Glich et al. (Eds. pp. 67-88 CRC Press, 1993); and by Phillips et al. "Cell-Tissue Culture and In-Vitro Manipulation" in Corn & Corn Improvement, 3rd Edition 10Sprague et al. (Eds. pp. 345-387) American Society of Agronomy Inc. et al. 1988.

Methods of introducing polynucleotides into plant tissue include the direct infection or co-cultivation of plant cell with *Agrobacterium tumefaciens*, Horsch et al., Science, 227:1229 (1985). Descriptions of *Agrobacterium* vector systems and methods for *Agrobacterium*-mediated gene transfer provided by Gruber et al. supra.

Alternatively, polynucleotides are introduced into plant cells or other plant tissues using a direct gene transfer method such as microprojectile-mediated delivery, DNA injection, electroporation and the like. More preferably polynucleotides are introduced into plant tissues using the microprojectile media delivery with the biolistic device. See, for example, Tomes et al., "Direct DNA transfer into intact plant cells via microprojectile bombardment" In: Gamborg and Phillips (Eds.) Plant Cell, Tissue and Organ Culture: Fundamental Methods, Springer Verlag, Berlin (1995).

In another embodiment of the current invention, expression constructs can be used for gene expression in callus culture for the purpose of expressing marker genes encoding peptides or polypeptides that allow identification of transformed plants. Here, a promoter that is operatively linked to a polynucleotide to be transcribed is transformed into plant cells and the transformed tissue is then placed on callus-inducing media. If the transformation is conducted with leaf discs, for example, callus will initiate along the cut edges. Once callus growth has initiated, callus cells can be transferred to callus shoot-inducing or callus root-inducing media. Gene expression will occur in the callus cells developing on the appropriate media: callus root-inducing promoters will be activated on callus root-inducing media, etc. Examples of such peptides or polypeptides useful as transformation markers include, but are not limited to barstar, glyphosate, chloramphenicol acetyltransferase (CAT), kanamycin, spectinomycin, streptomycin or other antibiotic resistance enzymes, green fluorescent protein (GFP), and β-glucuronidase (GUS), etc. Some of the exemplary promoters of the row titled "The predicted promoter sequence" will also be capable of sustaining expression in some tissues or organs after the initiation or completion of regeneration. Examples of these tissues or organs are somatic embryos, cotyledon, hypocotyl, epicotyl, leaf, stems, roots, flowers and seed.

Integration into the host cell genome also can be accomplished by methods known in the art, for example, by the homologous sequences or T-DNA discussed above or using the cre-lox system (A. C. Vergunst et al., *Plant Mol. Biol.* 38:393 (1998)).

G. Utility

Common Uses

In yet another embodiment, the promoters of the present invention can be used to further understand developmental mechanisms. For example, promoters that are specifically induced during callus formation, somatic embryo formation, shoot formation or root formation can be used to explore the effects of overexpression, repression or ectopic expression of target genes, or for isolation of trans-acting factors.

The vectors of the invention can be used not only for expression of coding regions but may also be used in exon-trap cloning, or promoter trap procedures to detect differential gene expression in various tissues, K. Lindsey et al., 1993 "Tagging Genomic Sequences That Direct Transgene Expression by Activation of a Promoter Trap in Plants", Transgenic Research 2:3347. D. Auch & Reth, et al., "Exon Trap Cloning: Using PCR to Rapidly Detect and Clone Exons from Genomic DNA Fragments", Nucleic Acids Research, Vol. 18, No. 22, p. 674.

Entrapment vectors, first described for use in bacteria (Casadaban and Cohen, 1979, Proc. Nat. Aca. Sci. U.S.A., 76: 4530; Casadaban et al., 1980, J. Bacteriol., 143: 971) permit selection of insertional events that lie within coding sequences. Entrapment vectors can be introduced into pluripotent ES cells in culture and then passed into the germline via chimeras (Gossler et al., 1989, Science, 244: 463; Skarnes, 1990, Biotechnology, 8: 827). Promoter or gene trap vectors often contain a reporter gene, e.g., lacZ, lacking its own promoter and/or splice acceptor sequence upstream. That is, promoter gene traps contain a reporter gene with a splice site but no promoter. If the vector lands in a gene and is spliced into the gene product, then the reporter gene is expressed.

Recently, the isolation of preferentially-induced genes has been made possible with the use of sophisticated promoter traps (e.g. IVET) that are based on conditional auxotrophy complementation or drug resistance. In one IVET approach, various bacterial genome fragments are placed in front of a necessary metabolic gene coupled to a reporter gene. The DNA constructs are inserted into a bacterial strain otherwise lacking the metabolic gene, and the resulting bacteria are used to infect the host organism. Only bacteria expressing the metabolic gene survive in the host organism; consequently, inactive constructs can be eliminated by harvesting only bacteria that survive for some minimum period in the host. At the same time, constitutively active constructs can be eliminated by screening only bacteria that do not express the reporter gene under laboratory conditions. The bacteria selected by such a method contain constructs that are selectively induced only during infection of the host. The IVET approach can be modified for use in plants to identify genes induced in either the bacteria or the plant cells upon pathogen infection or root colonization. For information on IVET see the articles by Mahan et al. in Science 259:686-688 (1993), Mahan et al. in PNAS USA 92:669-673 (1995), Heithoff et al. in PNAS USA 94:934-939 (1997), and Wanget al. in PNAS USA. 93:10434 (1996).

Constitutive Transcription

Use of promoters and control elements providing constitutive transcription is desired for modulation of transcription in most cells of an organism under most environmental conditions. In a plant, for example, constitutive transcription is useful for modulating genes involved in defense, pest resistance, herbicide resistance, etc.

Constitutive up-regulation and transcription down-regulation is useful for these applications. For instance, genes, transcripts, and/or polypeptides that increase defense, pest and herbicide resistance may require constitutive up-regulation of transcription. In contrast, constitutive transcriptional down-regulation may be desired to inhibit those genes, transcripts, and/or polypeptides that lower defense, pest and herbicide resistance.

Typically, promoter or control elements that provide constitutive transcription produce transcription levels that are statistically similar in many tissues and environmental conditions observed.

Calculation of P-value from the different observed transcript levels is one means of determining whether a promoter or control element is providing constitutive up-regulation. P-value is the probability that the difference of transcript levels is not statistically significant. The higher the P-value, the more likely the difference of transcript levels is not significant. One formula used to calculate P-value is as follows:

$$\int \varphi(x)dx, \text{ integrated from } a \text{ to } \infty,$$

where $\varphi(x)$ is a normal distribution;

$$\text{where } a = \frac{|Sx - \mu|}{\sigma(\text{all Samples except } Sx)};$$

where $Sx$ = the intensity of the sample of interest where $\mu$ = is the average of the intensities of all samples except $Sx$, $$= \frac{\left(\sum S1 \ldots Sn\right) - Sx}{n - 1}$$

where $\sigma(S1 \ldots S11,$ not including $Sx)$=the standard deviation of all sample intensities except $Sx$.

The P-value from the formula ranges from 1.0 to 0.0.

Usually, each P-value of the transcript levels observed in a majority of cells, tissues, or organs under various environmental conditions produced by the promoter or control element is greater than $10^{-8}$; more usually, greater than $10^{-7}$; even more usually, greater than $10^{-6}$; even more usually, greater than $10^{-5}$ or $10^{-4}$.

For up-regulation of transcription, promoter and control elements produce transcript levels that are above background of the assay.

Stress Induced Preferential Transcription

Promoters and control elements providing modulation of transcription under oxidative, drought, oxygen, wound, and methyl jasmonate stress are particularly useful for producing host cells or organisms that are more resistant to biotic and abiotic stresses. In a plant, for example, modulation of genes, transcripts, and/or polypeptides in response to oxidative stress can protect cells against damage caused by oxidative agents, such as hydrogen peroxide and other free radicals.

Drought induction of genes, transcripts, and/or polypeptides are useful to increase the viability of a plant, for example, when water is a limiting factor. In contrast, genes, transcripts, and/or polypeptides induced during oxygen stress can help the flood tolerance of a plant.

The promoters and control elements of the present invention can modulate stresses similar to those described in, for example, stress conditions are VuPLD1 (drought stress; Cowpea; see Pham-Thi et al. 1999. Plant molecular Biology. 1257-65), pyruvate decarboxylase (oxygen stress; rice; see Rivosal et al. 1997. Plant Physiol. 114(3): 1021-29), chromoplast specific carotenoid gene (oxidative stress; capsicum; see Bouvier et al. 1998. Journal of Biological Chemistry 273: 30651-59).

Promoters and control elements providing preferential transcription during wounding or induced by methyl jasmonate can produce a defense response in host cells or organisms. In a plant, for example, preferential modulation of genes, transcripts, and/or polypeptides under such conditions is useful to induce a defense response to mechanical wounding, pest or pathogen attack or treatment with certain chemicals.

Promoters and control elements of the present invention also can trigger a response similar to those described for cf9 (viral pathogen; tomato; see O'Donnell et al. 1998. The Plant journal: for cell and molecular biology 14(1): 137-42), hepatocyte growth factor activator inhibitor type 1 (HAI-1), which enhances tissue regeneration (tissue injury; human; Koono et al. 1999. Journal of Histochemistry and Cytochemistry 47: 673-82), copper amine oxidase (CuAO), induced during ontogenesis and wound healing (wounding; chick-pea; Rea et al. 1998. FEBS Letters 437: 177-82), proteinase inhibitor II (wounding; potato; see Pena-Cortes et al. 1988. Planta 174: 84-89), protease inhibitor II (methyl jasmonate; tomato; see Farmer and Ryan. 1990. Proc Natl Acad Sci USA 87: 7713-7716), two vegetative storage protein genes VspA and VspB (wounding, jasmonic acid, and water deficit; soybean; see Mason and Mullet. 1990. Plant Cell 2: 569-579).

Up-regulation and transcription down-regulation are useful for these applications. For instance, genes, transcripts, and/or polypeptides that increase oxidative, flood, or drought tolerance may require up-regulation of transcription. In contrast, transcriptional down-regulation may be desired to inhibit those genes, transcripts, and/or polypeptides that lower such tolerance.

Typically, promoter or control elements, which provide preferential transcription in wounding or under methyl jasmonate induction, produce transcript levels that are statistically significant as compared to cell types, organs or tissues under other conditions.

For preferential up-regulation of transcription, promoter and control elements produce transcript levels that are above background of the assay.

Light Induced Preferential Transcription

Promoters and control elements providing preferential transcription when induced by light exposure can be utilized to modulate growth, metabolism, and development; to increase drought tolerance; and decrease damage from light stress for host cells or organisms. In a plant, for example, modulation of genes, transcripts, and/or polypeptides in response to light is useful (1) to increase the photosynthetic rate;
(2) to increase storage of certain molecules in leaves or green parts only, e.g., silage with high protein or starch content;
(3) to modulate production of exogenous compositions in green tissue, e.g., certain feed enzymes;
(4) to induce growth or development, such as fruit development and maturity, during extended exposure to light;

(5) to modulate guard cells to control the size of stomata in leaves to prevent water loss, or (6) to induce accumulation of beta-carotene to help plants cope with light induced stress.

The promoters and control elements of the present invention also can trigger responses similar to those described in: abscisic acid insensitive3 (ABI3) (dark-grown *Arabidopsis* seedlings, see Rohde et al. 2000. The Plant Cell 12: 35-52), asparagine synthetase (pea root nodules, see Tsai, F. Y.; Coruzzi, G. M. 1990. EMBO J 9: 323-32), mdm2 gene (human tumor; see Saucedo et al. 1998. Cell Growth Differ 9: 119-30).

Up-regulation and transcription down-regulation are useful for these applications. For instance, genes, transcripts, and/or polypeptides that increase drought or light tolerance may require up-regulation of transcription. In contrast, transcriptional down-regulation may be desired to inhibit those genes, transcripts, and/or polypeptides that lower such tolerance.

Typically, promoter or control elements, which provide preferential transcription in cells, tissues or organs exposed to light, produce transcript levels that are statistically significant as compared to cells, tissues, or organs under decreased light exposure (intensity or length of time).

For preferential up-regulation of transcription, promoter and control elements produce transcript levels that are above background of the assay.

Dark Induced Preferential Transcription

Promoters and control elements providing preferential transcription when induced by dark or decreased light intensity or decreased light exposure time can be utilized to time growth, metabolism, and development, to modulate photosynthesis capabilities for host cells or organisms. In a plant, for example, modulation of genes, transcripts, and/or polypeptides in response to dark is useful, for example, (1) to induce growth or development, such as fruit development and maturity, despite lack of light;

(2) to modulate genes, transcripts, and/or polypeptide active at night or on cloudy days; or (3) to preserve the plastid ultra structure present at the onset of darkness.

The present promoters and control elements can also trigger response similar to those described in the section above.

Up-regulation and transcription down-regulation is useful for these applications. For instance, genes, transcripts, and/or polypeptides that increase growth and development may require up-regulation of transcription. In contrast, transcriptional down-regulation may be desired to inhibit those genes, transcripts, and/or polypeptides that modulate photosynthesis capabilities.

Typically, promoter or control elements, which provide preferential transcription under exposure to dark or decrease light intensity or decrease exposure time, produce transcript levels that are statistically significant.

For preferential up-regulation of transcription, promoter and control elements produce transcript levels that are above background of the assay.

Leaf Preferential Transcription

Promoters and control elements providing preferential transcription in a leaf can modulate growth, metabolism, and development or modulate energy and nutrient utilization in host cells or organisms. In a plant, for example, preferential modulation of genes, transcripts, and/or polypeptide in a leaf, is useful, for example, (1) to modulate leaf size, shape, and development;

(2) to modulate the number of leaves; or (3) to modulate energy or nutrient usage in relation to other organs and tissues Up-regulation and transcription down-regulation is useful for these applications. For instance, genes, transcripts, and/or polypeptides that increase growth, for example, may require up-regulation of transcription. In contrast, transcriptional down-regulation may be desired to inhibit energy usage in a leaf to be directed to the fruit instead, for instance.

Typically, promoter or control elements, which provide preferential transcription in the cells, tissues, or organs of a leaf, produce transcript levels that are statistically significant as compared to other cells, organs or tissues.

For preferential up-regulation of transcription, promoter and control elements produce transcript levels that are above background of the assay.

Root Preferential Transcription

Promoters and control elements providing preferential transcription in a root can modulate growth, metabolism, development, nutrient uptake, nitrogen fixation, or modulate energy and nutrient utilization in host cells or organisms. In a plant, for example, preferential modulation of genes, transcripts, and/or in a leaf, is useful (1) to modulate root size, shape, and development;

(2) to modulate the number of roots, or root hairs;

(3) to modulate mineral, fertilizer, or water uptake;

(4) to modulate transport of nutrients; or (4) to modulate energy or nutrient usage in relation to other organs and tissues.

Up-regulation and transcription down-regulation is useful for these applications. For instance, genes, transcripts, and/or polypeptides that increase growth, for example, may require up-regulation of transcription. In contrast, transcriptional down-regulation may be desired to inhibit nutrient usage in a root to be directed to the leaf instead, for instance.

Typically, promoter or control elements, which provide preferential transcription in cells, tissues, or organs of a root, produce transcript levels that are statistically significant as compared to other cells, organs or tissues.

For preferential up-regulation of transcription, promoter and control elements produce transcript levels that are above background of the assay.

Stem/Shoot Preferential Transcription

Promoters and control elements providing preferential transcription in a stem or shoot can modulate growth, metabolism, and development or modulate energy and nutrient utilization in host cells or organisms. In a plant, for example, preferential modulation of genes, transcripts, and/or polypeptide in a stem or shoot, is useful, for example, (1) to modulate stem/shoot size, shape, and development; or (2) to modulate energy or nutrient usage in relation to other organs and tissues Up-regulation and transcription down-regulation is useful for these applications. For instance, genes, transcripts, and/or polypeptides that increase growth, for example, may require up-regulation of transcription. In contrast, transcriptional down-regulation may be desired to inhibit energy usage in a stem/shoot to be directed to the fruit instead, for instance.

Typically, promoter or control elements, which provide preferential transcription in the cells, tissues, or organs of a stem or shoot, produce transcript levels that are statistically significant as compared to other cells, organs or tissues.

For preferential up-regulation of transcription, promoter and control elements produce transcript levels that are above background of the assay.

Fruit and Seed Preferential Transcription

Promoters and control elements providing preferential transcription in a silique or fruit can time growth, development, or maturity; or modulate fertility; or modulate energy and nutrient utilization in host cells or organisms. In a plant, for example, preferential modulation of genes, transcripts, and/or polypeptides in a fruit, is useful (1) to modulate fruit size, shape, development, and maturity;
(2) to modulate the number of fruit or seeds;
(3) to modulate seed shattering;
(4) to modulate components of seeds, such as, storage molecules, starch, protein, oil, vitamins, anti-nutritional components, such as phytic acid;
(5) to modulate seed and/or seedling vigor or viability;
(6) to incorporate exogenous compositions into a seed, such as lysine rich proteins;
(7) to permit similar fruit maturity timing for early and late blooming flowers; or
(8) to modulate energy or nutrient usage in relation to other organs and tissues.

Up-regulation and transcription down-regulation is useful for these applications. For instance, genes, transcripts, and/or polypeptides that increase growth, for example, may require up-regulation of transcription. In contrast, transcriptional down-regulation may be desired to inhibit late fruit maturity, for instance.

Typically, promoter or control elements, which provide preferential transcription in the cells, tissues, or organs of siliques or fruits, produce transcript levels that are statistically significant as compared to other cells, organs or tissues.

For preferential up-regulation of transcription, promoter and control elements produce transcript levels that are above background of the assay.

Callus Preferential Transcription

Promoters and control elements providing preferential transcription in a callus can be useful to modulating transcription in dedifferentiated host cells. In a plant transformation, for example, preferential modulation of genes, transcripts, in callus is useful to modulate transcription of a marker gene, which can facilitate selection of cells that are transformed with exogenous polynucleotides.

Up-regulation and transcription down-regulation is useful for these applications. For instance, genes, transcripts, and/or polypeptides that increase marker gene detectability, for example, may require up-regulation of transcription. In contrast, transcriptional down-regulation may be desired to increase the ability of the calluses to later differentiate, for instance.

Typically, promoter or control elements, which provide preferential transcription in callus, produce transcript levels that are statistically significant as compared to other cell types, tissues, or organs. Calculation of P-value from the different observed transcript levels is one means of determining whether a promoter or control element is providing such preferential transcription.

Usually, each P-value of the transcript levels observed in callus as compared to, at least one other cell type, tissue or organ, is less than $10^{-4}$; more usually, less than $10^{-5}$; even more usually, less than $10^{-6}$; even more usually, less than $10^{-7}$ or $10^{-8}$.

For preferential up-regulation of transcription, promoter and control elements produce transcript levels that are above background of the assay.

Flower Specific Transcription

Promoters and control elements providing preferential transcription in flowers can modulate pigmentation; or modulate fertility in host cells or organisms. In a plant, for example, preferential modulation of genes, transcripts, and/or polypeptides in a flower, is useful, (1) to modulate petal color; or
(2) to modulate the fertility of pistil and/or stamen.

Up-regulation and transcription down-regulation is useful for these applications. For instance, genes, transcripts, and/or polypeptides that increase pigmentation, for example, may require up-regulation of transcription. In contrast, transcriptional down-regulation may be desired to inhibit fertility, for instance.

Typically, promoter or control elements, which provide preferential transcription in flowers, produce transcript levels that are statistically significant as compared to other cells, organs or tissues.

For preferential up-regulation of transcription, promoter and control elements produce transcript levels that are above background of the assay.

Immature Bud and Inflorescence Preferential Transcription

Promoters and control elements providing preferential transcription in a immature bud or inflorescence can time growth, development, or maturity; or modulate fertility or viability in host cells or organisms. In a plant, for example, preferential modulation of genes, transcripts, and/or polypeptide in a fruit, is useful, (1) to modulate embryo development, size, and maturity;
(2) to modulate endosperm development, size, and composition;
(3) to modulate the number of seeds and fruits; or
(4) to modulate seed development and viability.

Up-regulation and transcription down-regulation is useful for these applications. For instance, genes, transcripts, and/or polypeptides that increase growth, for example, may require up-regulation of transcription. In contrast, transcriptional down-regulation may be desired to decrease endosperm size, for instance.

Typically, promoter or control elements, which provide preferential transcription in immature buds and inflorescences, produce transcript levels that are statistically significant as compared to other cell types, organs or tissues.

For preferential up-regulation of transcription, promoter and control elements produce transcript levels that are above background of the assay.

Senescence Preferential Transcription

Promoters and control elements providing preferential transcription during senescence can be used to modulate cell degeneration, nutrient mobilization, and scavenging of free radicals in host cells or organisms. Other types of responses that can be modulated include, for example, senescence associated genes (SAG) that encode enzymes thought to be involved in cell degeneration and nutrient mobilization (Arabidopsis; see Hensel et al. 1993. Plant Cell 5: 553-64), and the CP-2/cathepsin L gene (rat; Kim and Wright. 1997. Biol Reprod 57: 1467-77), both induced during senescence.

In a plant, for example, preferential modulation of genes, transcripts, and/or polypeptides during senescencing is useful to modulate fruit ripening.

Up-regulation and transcription down-regulation is useful for these applications. For instance, genes, transcripts, and/or polypeptides that increase scavenging of free radicals, for example, may require up-regulation of transcription. In contrast, transcriptional down-regulation may be desired to inhibit cell degeneration, for instance.

Typically, promoter or control elements, which provide preferential transcription in cells, tissues, or organs during senescence, produce transcript levels that are statistically significant as compared to other conditions.

For preferential up-regulation of transcription, promoter and control elements produce transcript levels that are above background of the assay.

Germination Preferential Transcription

Promoters and control elements providing preferential transcription in a germinating seed can time growth, development, or maturity; or modulate viability in host cells or organisms. In a plant, for example, preferential modulation of genes, transcripts, and/or polypeptide in a germinating seed, is useful, (1) to modulate the emergence of they hypocotyls, cotyledons and radical; or
(2) to modulate shoot and primary root growth and development;

Up-regulation and transcription down-regulation is useful for these applications. For instance, genes, transcripts, and/or polypeptides that increase growth, for example, may require up-regulation of transcription. In contrast, transcriptional down-regulation may be desired to decrease endosperm size, for instance.

Typically, promoter or control elements, which provide preferential transcription in a germinating seed, produce transcript levels that are statistically significant as compared to other cell types, organs or tissues.

For preferential up-regulation of transcription, promoter and control elements produce transcript levels that are above background of the assay.

Microarray Analysis

A major way that a cell controls its response to internal or external stimuli is by regulating the rate of transcription of specific genes. For example, the differentiation of cells during organogenesis into forms characteristic of the organ is associated with the selective activation and repression of large numbers of genes. Thus, specific organs, tissues and cells are functionally distinct due to the different populations of mRNAs and protein products they possess. Internal signals program the selective activation and repression programs. For example, internally synthesized hormones produce such signals. The level of hormone can be raised by increasing the level of transcription of genes encoding proteins concerned with hormone synthesis.

To measure how a cell reacts to internal and/or external stimuli, individual mRNA levels can be measured and used as an indicator for the extent of transcription of the gene. Cells can be exposed to a stimulus, and mRNA can be isolated and assayed at different time points after stimulation. The mRNA from the stimulated cells can be compared to control cells that were not stimulated. The mRNA levels that are higher in the stimulated cell versus the control indicate a stimulus-specific response of the cell. The same is true of mRNA levels that are lower in stimulated cells versus the control condition.

Similar studies can be performed with cells taken from an organism with a defined mutation in their genome as compared with cells without the mutation. Altered mRNA levels in the mutated cells indicate how the mutation causes transcriptional changes. These transcriptional changes are associated with the phenotype that the mutated cells exhibit that is different from the phenotype exhibited by the control cells.

Applicants have utilized microarray techniques to measure the levels of mRNAs in cells from plants transformed with a construct containing the promoter or control elements of the present invention together with their endogenous cDNA sequences. In general, transformants with the constructs were grown to an appropriate stage, and tissue samples were prepared for the microarray differential expression analysis. In this manner it is possible to determine the differential expression for the cDNAs under the control of the endogenous promoter under various conditions.

Microarray Experimental Procedures and Results

Procedures

1. Sample Tissue Preparation

Tissue samples for each of the expression analysis experiments were prepared as follows:

(a) Roots

Seeds of Arabidopsis *thaliana* (Ws) were sterilized in full strength bleach for less than 5 min., washed more than 3 times in sterile distilled deionized water and plated on MS agar plates. The plates were placed at 4° C. for 3 nights and then placed vertically into a growth chamber having 16 hr light/8 hr dark cycles, 23° C., 70% relative humidity and ~11,000 LUX. After 2 weeks, the roots were cut from the agar, flash frozen in liquid nitrogen and stored at −80° C.

(b) Rosette Leaves, Stems, and Siliques

*Arabidopsis thaliana* (Ws) seed was vernalized at 4° C. for 3 days before sowing in Metro-mix soil type 350. Flats were placed in a growth chamber having 16 hr light/8 hr dark, 80% relative humidity, 23° C. and 13,000 LUX for germination and growth. After 3 weeks, rosette leaves, stems, and siliques were harvested, flash frozen in liquid nitrogen and stored at −80° C. until use. After 4 weeks, siliques (<5 mm, 5-10 mm and >10 mm) were harvested, flash frozen in liquid nitrogen and stored at −80° C. until use. 5 week old whole plants (used as controls) were harvested, flash frozen in liquid nitrogen and kept at −80° C. until RNA was isolated.

(c) Germination

*Arabidopsis thaliana* seeds (ecotype Ws) were sterilized in bleach and rinsed with sterile water. The seeds were placed in 100 mm petri plates containing soaked autoclaved filter paper. Plates were foil-wrapped and left at 4° C. for 3 nights to vernalize. After cold treatment, the foil was removed and plates were placed into a growth chamber having 16 hr light/8 hr dark cycles, 23° C., 70% relative humidity and ~11,000 lux. Seeds were collected 1 d, 2 d, 3 d and 4 d later, flash frozen in liquid nitrogen and stored at −80° C. until RNA was isolated.

(d) Abscissic Acid (ABA)

Seeds of *Arabidopsis thaliana* (ecotype Wassilewskija) were sown in trays and left at 4° C. for 4 days to vernalize. They were then transferred to a growth chamber having grown 16 hr light/8 hr dark, 13,000 LUX, 70% humidity, and 20° C. and watered twice a week with 1 L of 1×Hoagland's solution. Approximately 1,000 14 day old plants were spayed with 200-250 mls of 100 μM ABA in a 0.02% solution of the detergent Silwet L-77. Whole seedlings, including roots, were harvested within a 15 to 20 minute time period at 1 hr and 6 hr after treatment, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 100 μM ABA for treatment. Control plants were treated with water. After 6 hr and 24 hr, aerial and root tissues were separated and flash frozen in liquid nitrogen prior to storage at −80° C.

(e) Brassinosteroid Responsive

Two separate experiments were performed, one with epi-brassinolide and one with the brassinosteroid biosynthetic inhibitor brassinazole. In the epi-brassinolide experiments, seeds of wild-type *Arabidopsis thaliana* (ecotype Wassilewskija) and the brassinosteroid biosynthetic mutant dwf4-1 were sown in trays and left at 4° C. for 4 days to vernalize. They were then transferred to a growth chamber having 16 hr light/8 hr dark, 11,000 LUX, 70% humidity and 22° C. temperature. Four week old plants were spayed with a 1 µM solution of epi-brassinolide and shoot parts (unopened floral primordia and shoot apical meristems) harvested three hours later. Tissue was flash-frozen in liquid nitrogen and stored at −80° C. In the brassinazole experiments, seeds of wild-type *Arabidopsis thaliana* (ecotype Wassilewskija) were grown as described above. Four week old plants were spayed with a 1 µM solution of brassinazole and shoot parts (unopened floral primordia and shoot apical meristems) harvested three hours later. Tissue was flash-frozen in liquid nitrogen and stored at −80° C.

In addition to the spray experiments, tissue was prepared from two different mutants; (1) a dwf4-1 knock out mutant and (2) a mutant overexpressing the dwf4-1 gene.

Seeds of wild-type *Arabidopsis thaliana* (ecotype Wassilewskija) and of the dwf4-1 knock out and overexpressor mutants were sown in trays and left at 4° C. for 4 days to vernalize. They were then transferred to a growth chamber having 16 hr light/8 hr dark, 11,000 LUX, 70% humidity and 22° C. temperature. Tissue from shoot parts (unopened floral primordia and shoot apical meristems) was flash-frozen in liquid nitrogen and stored at −80° C.

Another experiment was completed with seeds of *Arabidopsis thaliana* (ecotype Wassilewskija) were sown in trays and left at 4° C. for 4 days to vernalize. They were then transferred to a growth chamber. Plants were grown under long-day (16 hr light: 8 hr. dark) conditions, 13,000 LUX light intensity, 70% humidity, 20° C. temperature and watered twice a week with 1 L 1× Hoagland's solution (recipe recited in Feldmann et al., (1987) Mol. Gen. Genet. 208: 1-9 and described as complete nutrient solution). Approximately 1,000 14 day old plants were spayed with 200-250 mls of 0.1 µM Epi-Brassinolite in 0.02% solution of the detergent Silwet L-77. At 1 hr. and 6 hrs. after treatment aerial tissues were harvested within a 15 to 20 minute time period and flash-frozen in liquid nitrogen.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 0.1 µM epi-brassinolide for treatment. Control plants were treated with distilled deionized water. After 24 hr, aerial and root tissues were separated and flash frozen in liquid nitrogen prior to storage at −80° C.

(f) Nitrogen: High to Low

Wild type *Arabidopsis thaliana* seeds (ecotpye Ws) were surface sterilized with 30% Clorox, 0.1% Triton X-100 for 5 minutes. Seeds were then rinsed with 4-5 exchanges of sterile double distilled deionized water. Seeds were vernalized at 4° C. for 2-4 days in darkness. After cold treatment, seeds were plated on modified 1×MS media (without $NH_4NO_3$ or $KNO_3$), 0.5% sucrose, 0.5 g/L MES pH5.7, 1% phytagar and supplemented with $KNO_3$ to a final concentration of 60 mM (high nitrate modified 1×MS media). Plates were then grown for 7 days in a Percival growth chamber at 22° C. with 16 hr. light/8 hr dark.

Germinated seedlings were then transferred to a sterile flask containing 50 mL of high nitrate modified 1×MS liquid media. Seedlings were grown with mild shaking for 3 additional days at 22° C. in 16 hr. light/8 hr dark (in a Percival growth chamber) on the high nitrate modified 1×MS liquid media.

After three days of growth on high nitrate modified 1×MS liquid media, seedlings were transferred either to a new sterile flask containing 50 mL of high nitrate modified 1×MS liquid media or to low nitrate modified 1×MS liquid media (containing 20 □M $KNO_3$). Seedlings were grown in these media conditions with mild shaking at 22° C. in 16 hr light/8 hr dark for the appropriate time points and whole seedlings harvested for total RNA isolation via the Trizol method (LifeTech.). The time points used for the microarray experiments were 10 min. and 1 hour time points for both the high and low nitrate modified 1×MS media.

Alternatively, seeds that were surface sterilized in 30% bleach containing 0.1% Triton X-100 and further rinsed in sterile water, were planted on MS agar, (0.5% sucrose) plates containing 50 mM $KNO_3$ (potassium nitrate). The seedlings were grown under constant light (3500 LUX) at 22° C. After 12 days, seedlings were transferred to MS agar plates containing either 1 mM $KNO_3$ or 50 mM $KNO_3$. Seedlings transferred to agar plates containing 50 mM $KNO_3$ were treated as controls in the experiment. Seedlings transferred to plates with 1 mM $KNO_3$ were rinsed thoroughly with sterile MS solution containing 1 mM $KNO_3$. There were ten plates per transfer. Root tissue was collected and frozen in 15 mL Falcon tubes at various time points which included 1 hour, 2 hours, 3 hours, 4 hours, 6 hours, 9 hours, 12 hours, 16 hours, and 24 hours.

Maize 35A19 Pioneer hybrid seeds were sown on flats containing sand and grown in a Conviron growth chamber at 25° C., 16 hr light/8 hr dark, ~13,000 LUX and 80% relative humidity. Plants were watered every three days with double distilled deionized water. Germinated seedlings are allowed to grow for 10 days and were watered with high nitrate modified 1×MS liquid media (see above). On day 11, young corn seedlings were removed from the sand (with their roots intact) and rinsed briefly in high nitrate modified 1×MS liquid media. The equivalent of half a flat of seedlings were then submerged (up to their roots) in a beaker containing either 500 mL of high or low nitrate modified 1×MS liquid media (see above for details).

At appropriate time points, seedlings were removed from their respective liquid media, the roots separated from the shoots and each tissue type flash frozen in liquid nitrogen and stored at −80° C. This was repeated for each time point. Total RNA was isolated using the Trizol method (see above) with root tissues only.

Corn root tissues isolated at the 4 hr and 16 hr time points were used for the microarray experiments. Both the high and low nitrate modified 1×MS media were used.

(g) Nitrogen: Low to High

*Arabidopsis thaliana* ecotype Ws seeds were sown on flats containing 4 L of a 1:2 mixture of Grace Zonolite vermiculite and soil. Flats were watered with 3 L of water and vernalized at 4° C. for five days. Flats were placed in a Conviron growth chamber having 16 hr light/8 hr dark at 20° C., 80% humidity and 17,450 LUX. Flats were watered with approximately 1.5 L of water every four days. Mature, bolting plants (24 days after germination) were bottom treated with 2 L of either a control (100 mM mannitol pH 5.5) or an experimental (50 mM ammonium nitrate, pH 5.5) solution. Roots, leaves and siliques were harvested separately 30, 120 and 240 minutes after treatment, flash frozen in liquid nitrogen and stored at −80° C.

Hybrid maize seed (Pioneer hybrid 35A19) were aerated overnight in deionized water. Thirty seeds were plated in each flat, which contained 4 liters of Grace zonolite vermiculite. Two liters of water were bottom fed and flats were kept in a Conviron growth chamber with 16 hr light/8 hr dark at 20° C. and 80% humidity. Flats were watered with 1 L of tap water every three days. Five day old seedlings were treated as described above with 2 L of either a control (100 mM mannitol pH 6.5) solution or 1 L of an experimental (50 mM ammonium nitrate, pH 6.8) solution. Fifteen shoots per time point per treatment were harvested 10, 90 and 180 minutes after treatment, flash frozen in liquid nitrogen and stored at −80° C.

Alternatively, seeds of *Arabidopsis thaliana* (ecotype Wassilewskija) were left at 4° C. for 3 days to vernalize. They were then sown on vermiculite in a growth chamber having 16 hours light/8 hours dark, 12,000-14,000 LUX, 70% humidity, and 20° C. They were bottom-watered with tap water, twice weekly. Twenty-four days old plants were sprayed with either water (control) or 0.6% ammonium nitrate at 4 μL/cm² of tray surface. Total shoots and some primary roots were cleaned of vermiculite, flash-frozen in liquid nitrogen and stored at −80° C.

(h) Methyl Jasmonate

Seeds of *Arabidopsis thaliana* (ecotype Wassilewskija) were sown in trays and left at 4° C. for 4 days to vernalize before being transferred to a growth chamber having 16 hr light/8 hr. dark, 13,000 LUX, 70% humidity, 20° C. temperature and watered twice a week with 1 L of a 1× Hoagland's solution. Approximately 1,000 14 day old plants were spayed with 200-250 mls of 0.001% methyl jasmonate in a 0.02% solution of the detergent Silwet L-77. At 1 hr and 6 hrs after treatment, whole seedlings, including roots, were harvested within a 15 to 20 minute time period, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 0.001% methyl jasmonate for treatment. Control plants were treated with water. After 24 hr, aerial and root tissues were separated and flash frozen in liquid nitrogen prior to storage at −80° C.

(i) Salicylic Acid

Seeds of *Arabidopsis thaliana* (ecotype Wassilewskija) were sown in trays and left at 4° C. for 4 days to vernalize before being transferred to a growth chamber having 16 hr light/8 hr. dark, 13,000 LUX, 70% humidity, 20° C. temperature and watered twice a week with 1 L of a 1× Hoagland's solution. Approximately 1,000 14 day old plants were spayed with 200-250 mls of 5 mM salicylic acid (solubilized in 70% ethanol) in a 0.02% solution of the detergent Silwet L-77. At 1 hr and 6 hrs after treatment, whole seedlings, including roots, were harvested within a 15 to 20 minute time period flash-frozen in liquid nitrogen and stored at −80° C.

Alternatively, seeds of wild-type *Arabidopsis thaliana* (ecotype Columbia) and mutant CS3726 were sown in soil type 200 mixed with osmocote fertilizer and Marathon insecticide and left at 4° C. for 3 days to vernalize. Flats were incubated at room temperature with continuous light. Sixteen days post germination plants were sprayed with 2 mM SA, 0.02% SilwettL-77 or control solution (0.02% SilwettL-77. Aerial parts or flowers were harvested 1 hr, 4 hr, 6 hr, 24 hr and 3 weeks post-treatment flash frozen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 2 mM SA for treatment. Control plants were treated with water. After 12 hr and 24 hr, aerial and root tissues were separated and flash frozen in liquid nitrogen prior to storage at −80° C.

(j) Drought Stress

Seeds of *Arabidopsis thaliana* (Wassilewskija) were sown in pots and left at 4° C. for three days to vernalize before being transferred to a growth chamber having 16 hr light/8 hr dark, 150,000-160,000 LUX, 20° C. and 70% humidity. After 14 days, aerial tissues were cut and left to dry on 3MM Whatman paper in a Petri-plate for 1 hour and 6 hours. Aerial tissues exposed for 1 hour and 6 hours to 3 MM Whatman paper wetted with 1×Hoagland's solution served as controls. Tissues were harvested, flash-frozen in liquid nitrogen and stored at −80° C.

Alternatively, *Arabidopsis thaliana* (Ws) seed was vernalized at 4° C. for 3 days before sowing in Metromix soil type 350. Flats were placed in a growth chamber with 23° C., 16 hr light/8 hr. dark, 80% relative humidity, ~13,000 LUX for germination and growth. Plants were watered with 1-1.5 L of water every four days. Watering was stopped 16 days after germination for the treated samples, but continued for the control samples. Rosette leaves and stems, flowers and siliques were harvested 2 d, 3 d, 4 d, 5 d, 6 d and 7 d after watering was stopped. Tissue was flash frozen in liquid nitrogen and kept at −80° C. until RNA was isolated. Flowers and siliques were also harvested on day 8 from plants that had undergone a 7 d drought treatment followed by 1 day of watering. Control plants (whole plants) were harvested after 5 weeks, flash frozen in liquid nitrogen and stored as above.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in empty 1-liter beakers at room temperature for treatment. Control plants were placed in water. After 1 hr, 6 hr, 12 hr and 24 hr aerial and root tissues were separated and flash frozen in liquid nitrogen prior to storage at −80° C.

(k) Osmotic Stress

Seeds of *Arabidopsis thaliana* (Wassilewskija) were sown in trays and left at 4° C. for three days to vernalize before being transferred to a growth chamber having 16 hr light/8 hr dark, 12,000-14,000 LUX, 20° C., and 70% humidity. After 14 days, the aerial tissues were cut and placed on 3 MM Whatman paper in a petri-plate wetted with 20% PEG (polyethylene glycol-$M_r$ 8,000) in 1× Hoagland's solution. Aerial tissues on 3 MM Whatman paper containing 1× Hoagland's solution alone served as the control. Aerial tissues were harvested at 1 hour and 6 hours after treatment, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 10% PEG (polyethylene glycol-$M_r$ 8,000) for treatment. Control plants were treated with water. After 1 hr and 6 hr aerial and root tissues were separated and flash frozen in liquid nitrogen prior to storage at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 150 mM NaCl for treatment. Control plants were treated with water. After 1 hr, 6 hr, and 24 hr aerial and root tissues were separated and flash frozen in liquid nitrogen prior to storage at −80° C.

(1) Heat Shock Treatment

Seeds of *Arabidopsis Thaliana* (Wassilewskija) were sown in trays and left at 4° C. for three days to vernalize before being transferred to a growth chamber with 16 hr light/8 hr dark, 12,000-14,000 Lux, 70% humidity and 20° C., fourteen day old plants were transferred to a 42° C. growth chamber and aerial tissues were harvested 1 hr and 6 hr after transfer. Control plants were left at 20° C. and aerial tissues were harvested. Tissues were flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers containing 42° C. water for treatment. Control plants were treated with water at 25° C. After 1 hr and 6 hr aerial and root tissues were separated and flash frozen in liquid nitrogen prior to storage at −80° C.

(m) Cold Shock Treatment

Seeds of *Arabidopsis thaliana* (Wassilewskija) were sown in trays and left at 4° C. for three days to vernalize before being transferred to a growth chamber having 16 hr light/8 hr dark, 12,000-14,000 LUX, 20° C. and 70% humidity. Fourteen day old plants were transferred to a 4° C. dark growth chamber and aerial tissues were harvested 1 hour and 6 hours later. Control plants were maintained at 20° C. and covered with foil to avoid exposure to light. Tissues were flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers containing 4° C. water for treatment. Control plants were treated with water at 25° C. After 1 hr and 6 hr aerial and root tissues were separated and flash frozen in liquid nitrogen prior to storage at −80° C.

(n) *Arabidopsis* Seeds

Fruits (pod+seed) 0-5 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Siliques 0-5 mm in length containing post fertilization through pre-heart stage [0-72 hours after fertilization (HAF)] embryos were harvested and flash frozen in liquid nitrogen.

Fruits (pod+seed) 5-10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Siliques 5-10 mm in length containing heart-through early upturned-U-stage [72-120 hours after fertilization (HAF)] embryos were harvested and flash frozen in liquid nitrogen.

Fruits (pod+seed)>10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Siliques >10 mm in length containing green, late upturned-U-stage [>120 hours after fertilization (HAF)-9 days after flowering (DAF)] embryos were harvested and flash frozen in liquid nitrogen.

Green Pods 5-10 mm (Control Tissue for Samples 72-74)

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Green siliques 5-10 mm in length containing developing seeds 72-120 hours after fertilization (HAF)] were opened and the seeds removed. The remaining tissues (green pods minus seed) were harvested and flash frozen in liquid nitrogen.

Green Seeds from Fruits >10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Green siliques >10 mm in length containing developing seeds up to 9 days after flowering (DAF)] were opened and the seeds removed and harvested and flash frozen in liquid nitrogen.

Brown Seeds from Fruits >10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Yellowing siliques >10 mm in length containing brown, dessicating seeds >11 days after flowering (DAF)] were opened and the seeds removed and harvested and flash frozen in liquid nitrogen.

Green/Brown Seeds from Fruits >10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Green siliques >10 mm in length containing both green and brown seeds >9 days after flowering (DAF)] were opened and the seeds removed and harvested and flash frozen in liquid nitrogen.

Mature Seeds (24 Hours after Imbibition)

Mature dry seeds of *Arabidopsis thaliana* (ecotype Wassilewskija) were sown onto moistened filter paper and left at 4° C. for two to three days to vernalize. Imbibed seeds were then transferred to a growth chamber [16 hr light: 8 hr dark conditions, 7000-8000 LUX light intensity, 70% humidity, and 22° C. temperature], the emerging seedlings harvested after 48 hours and flash frozen in liquid nitrogen.

Mature Seeds (Dry)

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature and taken to maturity. Mature dry seeds are collected, dried for one week at 28° C., and vernalized for one week at 4° C. before used as a source of RNA.

(o) Herbicide Treatment

*Arabidopsis thaliana* (Ws) seeds were sterilized for 5 min. with 30% bleach, 50 µl Triton in a total volume of 50 ml. Seeds were vernalized at 4° C. for 3 days before being plated onto GM agar plates at a density of about 144 seeds per plate. Plates were incubated in a Percival growth chamber having 16 hr light/8 hr dark, 80% relative humidity, 22° C. and 11,000 LUX for 14 days.

Plates were sprayed (~0.5 mls/plate) with water, Finale (1.128 g/L), Glean (1.88 g/L), RoundUp (0.01 g/L) or Trimec (0.08 g/L). Tissue was collected and flash frozen in liquid nitrogen at the following time points: 0, 1, 2, 4, 8, 12 and 24 hours. Frozen tissue was stored at −80° C. prior to RNA isolation.

(p) Root Tips

Seeds of *Arabidopsis thaliana* (ecotype Ws) were placed on MS plates and vernalized at 4° C. for 3 days before being placed in a 25° C. growth chamber having 16 hr light/8 hr dark, 70% relative humidity and about 3 W/m$^2$. After 6 days, young seedlings were transferred to flasks containing B5 liquid medium, 1% sucrose and 0.05 mg/l indole-3-butyric acid. Flasks were incubated at room temperature with 100 rpm agitation. Media was replaced weekly. After three weeks, roots were harvested and incubated for 1 hr with 2% pectinase, 0.2% cellulase, pH 7 before straining through a #80 (Sigma) sieve. The root body material remaining on the sieve (used as the control) was flash frozen and stored at −80° C. until use. The material that passed through the #80 sieve was strained through a #200 (Sigma) sieve and the material remaining on the sieve (root tips) was flash frozen and stored at −80° C. until use. Approximately 10 mg of root tips were collected from one flask of root culture.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 8 days. Seedlings were carefully removed from the sand and the root tips (~2 mm long) were removed and flash frozen in liquid nitrogen prior to storage at −80° C. The tissues above the root tips (~1 cm long) were cut, treated as above and used as control tissue.

(q) Imbibed Seed

Seeds of maize hybrid 35A (Pioneer) were sown in water-moistened sand in covered flats (10 rows, 5-6 seed/row) and covered with clear, plastic lids before being placed in a growth chamber having 16 hr light (25° C.)/8 hr dark (20° C.), 75% relative humidity and 13,000-14,000 LUX. One day after sowing, whole seeds were flash frozen in liquid nitrogen prior to storage at −80° C. Two days after sowing, embryos and endosperm were isolated and flash frozen in liquid nitrogen prior to storage at −80° C. On days 3-6, aerial tissues, roots and endosperm were isolated and flash frozen in liquid nitrogen prior to storage at −80° C.

(r) Flowers (Green, White or Buds)

Approximately 10 µl of *Arabidopsis thaliana* seeds (ecotype Ws) were sown on 350 soil (containing 0.03% marathon) and vernalized at 4 C for 3 days. Plants were then grown at room temperature under fluorescent lighting until flowering. Flowers were harvested after 28 days in three different categories. Buds that had not opened at all and were completely green were categorized as "flower buds" (also referred to as green buds by the investigator). Buds that had started to open, with white petals emerging slightly were categorized as "green flowers" (also referred to as white buds by the investigator). Flowers that had opened mostly (with no silique elongation) with white petals completely visible were categorized as "white flowers" (also referred to as open flowers by the investigator). Buds and flowers were harvested with forceps, flash frozen in liquid nitrogen and stored at −80 C until RNA was isolated.

s) Ovules

Seeds of *Arabidopsis thaliana* heterozygous for pistillata (pi) [ecotype Landsberg *erecta* (Ler)] were sown in pots and left at 4° C. for two to three days to vernalize. They were then transferred to a growth chamber. Plants were grown under long-day (16 hr light: 8 hr dark) conditions, 7000-8000 LUX light intensity, 76% humidity, and 24° C. temperature. Inflorescences were harvested from seedlings about 40 days old. The inflorescences were cut into small pieces and incubated in the following enzyme solution (pH 5) at room temperature for 0.5-1 hr.: 0.2% pectolyase Y-23, 0.04% pectinase, 5 mM MES, 3% Sucrose and MS salts (1900 mg/l $KNO_3$, 1650 mg/l $NH_4NO_3$, 370 mg/l $MgSO_4.7H_2O$, 170 mg/l $KH_2PO_4$, 440 mg/l $CaCl_2.2H_2O$, 6.2 mg/l $H_3BO_3$, 15.6 mg/l $MnSO_4.4H_2O$, 8.6 mg/l $ZnSO_4.7H_2O$, 0.25 mg/l $NaMoO_4.2H_2O$, 0.025 mg/l $CuCO_4.5H_2O$, 0.025 mg/l $CoCl_2.6H_2O$, 0.83 mg/l KI, 27.8 mg/l $FeSO_4.7H_2O$, 37.3 mg/l Disodium EDTA, pH 5.8). At the end of the incubation the mixture of inflorescence material and enzyme solution was passed through a size 60 sieve and then through a sieve with a pore size of 125 µm. Ovules greater than 125 µm in diameter were collected, rinsed twice in B5 liquid medium (2500 mg/l $KNO_3$, 250 mg/l $MgSO_4.7H_2O$, 150 mg/l $NaH_2PO_4.H_2O$, 150 mg/l $CaCl_2.2H_2O$, 134 mg/l $(NH4)2 CaCl_2.SO_4$, 3 mg/l $H_2BO_3$, 10 mg/l $MnSO_4.4H_2O$, 2 $ZnSO_4.7H_2O$, 0.25 mg/l $NaMoO_4$. $2H_2O$, 0.025 mg/l $CuCO_4.5H_2O$, 0.025 mg/l $CoCl_2.6H_2O$, 0.75 mg/l KI, 40 mg/l EDTA sodium ferric salt, 20 g/l sucrose, 10 mg/l Thiamine hydrochloride, 1 mg/l Pyridoxine hydrochloride, 1 mg/l Nicotinic acid, 100 mg/l myo-inositol, pH 5.5)), rinsed once in deionized water and flash frozen in liquid nitrogen. The supernatant from the 125 µm sieving was passed through subsequent sieves of 50 µm and 32 µm. The tissue retained in the 32 µm sieve was collected and mRNA prepared for use as a control.

t) Wounding

Seeds of *Arabidopsis thaliana* (Wassilewskija) were sown in trays and left at 4° C. for three days to vernalize before being transferred to a growth chamber having 16 hr light/8 hr dark, 12,000-14,000 LUX, 70% humidity and 20° C. After 14 days, the leaves were wounded with forceps. Aerial tissues were harvested 1 hour and 6 hours after wounding. Aerial tissues from unwounded plants served as controls. Tissues were flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were wounded (one leaf nicked by scissors) and placed in 1-liter beakers of water for treatment. Control plants were treated not wounded. After 1 hr and 6 hr aerial and root tissues were separated and flash frozen in liquid nitrogen prior to storage at −80° C.

u) Nitric Oxide Treatment

Seeds of *Arabidopsis thaliana* (Wassilewskija) were sown in trays and left at 4° C. for three days to vernalize before being transferred to a growth chamber having 16 hr light/8 hr dark, 12,000-14,000 LUX, 20° C. and 70% humidity. Fourteen day old plants were sprayed with 5 mM sodium nitroprusside in a 0.02% Silwett L-77 solution. Control plants were sprayed with a 0.02% Silwett L-77 solution. Aerial tissues were harvested 1 hour and 6 hours after spraying, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 5 mM nitroprusside for treatment. Control plants were treated with water. After 1 hr, 6 hr and 12 hr, aerial and root tissues were separated and flash frozen in liquid nitrogen prior to storage at −80° C.

v) Root Hairless Mutants

Plants mutant at the rhl gene locus lack root hairs. This mutation is maintained as a heterozygote.

Seeds of *Arabidopsis thaliana* (Landsberg *erecta*) mutated at the rhl gene locus were sterilized using 30% bleach with 1 ul/ml 20% Triton-X 100 and then vernalized at 4° C. for 3 days before being plated onto GM agar plates. Plates were placed in growth chamber with 16 hr light/8 hr. dark, 23° C., 14,500-15,900 LUX, and 70% relative humidity for germination and growth.

After 7 days, seedlings were inspected for root hairs using a dissecting microscope. Mutants were harvested and the cotyledons removed so that only root tissue remained Tissue was then flash frozen in liquid nitrogen and stored at −80 C.

*Arabidopsis thaliana* (Landsberg *erecta*) seedlings grown and prepared as above were used as controls.

Alternatively, seeds of *Arabidopsis thaliana* (Landsberg *erecta*), heterozygous for the rhl1 (root hairless) mutation, were surface-sterilized in 30% bleach containing 0.1% Triton X-100 and further rinsed in sterile water. They were then vernalized at 4° C. for 4 days before being plated onto MS agar plates. The plates were maintained in a growth chamber at 24° C. with 16 hr light/8 hr dark for germination and growth. After 10 days, seedling roots that expressed the phenotype (i.e. lacking root hairs) were cut below the hypocotyl junction, frozen in liquid nitrogen and stored at −80° C. Those seedlings with the normal root phenotype (heterozygous or wt) were collected as described for the mutant and used as controls.

w) Ap2

Seeds of *Arabidopsis thaliana* (ecotype Landesberg erecta) and floral mutant apetala2 (Jofuku et al., 1994, Plant Cell 6:1211-1225) were sown in pots and left at 4° C. for two to three days to vernalize. They were then transferred to a growth chamber. Plants were grown under long-day (16 hr light, 8 hr dark) conditions 7000-8000 LUX light intensity, 70% humidity and 22° C. temperature. Inflorescences containing immature floral buds (stages 1-7; Bowman, 1994) as well as the inflorescence meristem were harvested and flashfrozen. Polysomal polyA+RNA was isolated from tissue according to Cox and Goldberg, 1988).

x) Salt

*Arabidopsis thaliana* ecotype Ws seeds were vernalized at 4° C. for 3 days before sowing in flats containing vermiculite soil. Flats were placed at 20° C. in a Conviron growth chamber having 16 hr light/8 hr dark. Whole plants (used as controls) received water. Other plants were treated with 100 mM NaCl. After 6 hr and 72 hr, aerial and root tissues were harvested and flash frozen in liquid nitrogen prior to storage at −80° C.

y) Petals

*Arabidopsis thaliana* ecotype Ws seeds were vernalized at 4° C. for 3 days before sowing in flats containing vermiculite soil. Flats were watered placed at 20° C. in a Conviron growth chamber having 16 hr light/8 hr dark. Whole plants (used as the control) and petals from inflorescences 23-25 days after germination were harvested, flash frozen in liquid nitrogen and stored at −80° C.

z) Pollen

*Arabidopsis thaliana* ecotype Ws seeds were vernalized at 4° C. for 3 days before sowing in flats containing vermiculite soil. Flats were watered and placed at 20° C. in a Conviron growth chamber having 16 hr light/8 hr dark. Whole plants (used as controls) and pollen from plants 38 dap was harvested, flash frozen in liquid nitrogen and stored at −80° C.

aa) Interploidy Crosses

Interploidy crosses involving a 6× parent are lethal. Crosses involving a 4× parent are complete and analyzed. The imbalance in the maternal/paternal ratio produced from the cross can lead to big seeds. *Arabidopsis thaliana* ecotype Ws seeds were vernalized at 4° C. for 3 days before sowing. Small siliques were harvested at 5 days after pollination, flash frozen in liquid nitrogen and stored at −80° C.

bb) Line Comparisons

Alkaloid 35S over-expressing lines were used to monitor the expression levels of terpenoid/alkaloid biosynthetic and P450 genes to identify the transcriptional regulatory points I the biosynthesis pathway and the related P450 genes. *Arabidopsis thaliana* ecotype Ws seeds were vernalized at 4° C. for 3 days before sowing in vermiculite soil (Zonolite) supplemented by Hoagland solution. Flats were placed in Conviron growth chambers under long day conditions (16 hr light, 23° C./8 hr dark, 20° C.) Basta spray and selection of the overexpressing lines was conducted about 2 weeks after germination. Approximately 2-3 weeks after bolting (approximately 5-6 weeks after germination), stem and siliques from the over-expressing lines and from wild-type plants were harvested, flash frozen in liquid nitrogen and stored at −80° C.

cc) DMT-II

Demeter (dint) is a mutant of a methyl transferase gene and is similar to fie. *Arabidopsis thaliana* ecotype Ws seeds were vernalized at 4° C. for 3 days before sowing. Cauline leaves and closed flowers were isolated from 35S::DMT and dmt −/− plant lines, flash frozen in liquid nitrogen and stored at −80° C.

dd) CS6630 Roots and Shoots

*Arabidopsis thaliana* ecotype Ws seeds were vernalized at 4° C. for 3 days before sowing on MS media (1%) sucrose on bactor-agar. Roots and shoots were separated 14 days after germination, flash frozen in liquid nitrogen and stored at −80° C.

ee) CS237

CS237 is an ethylene triple response mutant that is insensitive to ethylene and which has an etr1-1 phenotype. *Arabidopsis thaliana* CS237 seeds were vernalized at 4° C. for 3 days before sowing. Aerial tissue was collected from mutants and wild-type Columbia ecotype plants, flash frozen in liquid nitrogen and stored at −80° C.

ff) Guard Cells

*Arabidopsis thaliana* ecotype Ws seeds were vernalized at 4° C. for 3 days before sowing. Leaves were harvested, homogenized and centrifuged to isolate the guard cell containing fraction. Homogenate from leaves served as the control. Samples were flash frozen in liquid nitrogen and stored at −80° C. Identical experiments using leaf tissue from canola were performed.

gg) 3642-1

3642-1 is a T-DNA mutant that affects leaf development. This mutant segregates 3:1, wild-type:mutant. *Arabidopsis thaliana* 3642-1 mutant seeds were vernalized at 4° C. for 3 days before sowing in flats of MetroMix 200. Flats were placed in the greenhouse, watered and grown to the 8 leaf, pre-flower stage. Stems and rosette leaves were harvested from the mutants and the wild-type segregants, flash frozen and stored at −80° C.

hh) Caf

Carple factory (Caf) is a double-stranded RNAse protein that is hypothesized to process small RNAs in *Arabidopsis*. The protein is closely related to a *Drosophila* protein named DICER that functions in the RNA degradation steps of RNA interference. *Arabidopsis thaliana* Caf mutant seeds were vernalized at 4° C. for 3 days before sowing in flats of MetroMix 200. Flats were placed in the greenhouse, watered and grown to the 8 leaf, pre-flower stage. Stems and rosette leaves were harvested from the mutants and the wild-type segregants, flash frozen and stored at −80° C.

2. Microarray Hybridization Procedures

Microarray technology provides the ability to monitor mRNA transcript levels of thousands of genes in a single experiment. These experiments simultaneously hybridize two differentially labeled fluorescent cDNA pools to glass slides that have been previously spotted with cDNA clones of the same species. Each arrayed cDNA spot will have a corresponding ratio of fluorescence that represents the level of disparity between the respective mRNA species in the two sample pools. Thousands of polynucleotides can be spotted on one slide, and each experiment generates a global expression pattern.

Coating Slides

The microarray consists of a chemically coated microscope slide, referred herein as a "chip" with numerous polynucleotide samples arrayed at a high density. The poly-L-lysine coating allows for this spotting at high density by providing a hydrophobic surface, reducing the spreading of spots of DNA solution arrayed on the slides. Glass microscope slides (Gold Seal #3010 manufactured by Gold Seal Products, Portsmouth, N.H., USA) were coated with a 0.1% W/V solution of Poly-L-lysine (Sigma, St. Louis, Mo.) using the following protocol:

1. Slides were placed in slide racks (Shandon Lipshaw #121). The racks were then put in chambers (Shandon Lipshaw #121).
2. Cleaning solution was prepared:
   70 g NaOH was dissolved in 280 mL ddH2O.
   420 mL 95% ethanol was added. The total volume was 700 mL (=2×350 mL); it was stirred until completely mixed. If the solution remained cloudy, ddH$_2$O was added until clear.
3. The solution was poured into chambers with slides; the chambers were covered with glass lids. The solution was mixed on an orbital shaker for 2 hr.
4. The racks were quickly transferred to fresh chambers filled with ddH$_2$O. They were rinsed vigorously by plunging racks up and down. Rinses were repeated 4× with fresh ddH$_2$O each time, to remove all traces of NaOH-ethanol.

5. Polylysine solution was prepared:
   0 mL poly-L-lysine+70 mL tissue culture PBS in 560 mL water, using plastic graduated cylinder and beaker.
6. Slides were transferred to polylysine solution and shaken for 1 hr.
7. The rack was transferred to a fresh chambers filled with ddH$_2$O. It was plunged up and down 5× to rinse.
8. The slides were centrifuged on microtiter plate carriers (paper towels were placed below the rack to absorb liquid) for 5 min @ 500 rpm. The slide racks were transferred to empty chambers with covers.
9. Slide racks were dried in a 45 C oven for 10 min.
10. The slides were stored in a closed plastic slide box.
11. Normally, the surface of lysine coated slides was not very hydrophobic immediately after this process, but became increasingly hydrophobic with storage. A hydrophobic surface helped ensure that spots didn't run together while printing at high densities.
   After they aged for 10 days to a month the slides were ready to use. However, coated slides that have been sitting around for long periods of time were usually too old to be used. This was because they developed opaque patches, visible when held to the light, and these resulted in high background hybridization from the fluorescent probe. Alternatively, pre-coated glass slides were purchased from TeleChem International, Inc. (Sunnyvale, Calif., 94089; catalog number SMM-25, Superamine substrates).

PCR Amplification of cDNA Clone Inserts

Polynucleotides were amplified from *Arabidopsis* cDNA clones using insert specific probes. The resulting 100 uL PCR reactions were purified with Qiaquick 96 PCR purification columns (Qiagen, Valencia, Calif., USA) and eluted in 30 uL of 5 mM Tris. 8.5 uL of the elution were mixed with 1.5 uL of 20×SSC to give a final spotting solution of DNA in 3×SSC. The concentrations of DNA generated from each clone varied between 10-100 ng/ul, but were usually about 50 ng/ul.

Arraying of PCR Products on Glass Slides

PCR products from cDNA clones were spotted onto the poly-L-Lysine coated glass slides using an arrangement of quill-tip pins (ChipMaker 3 spotting pins; Telechem, International, Inc., Sunnyvale, Calif., USA) and a robotic arrayer (PixSys 3500, Cartesian Technologies, Irvine, Calif., USA). Around 0.5 nl of a prepared PCR product was spotted at each location to produce spots with approximately 100 μm diameters. Spot center-to-center spacing was from 180 μm to 210 um depending on the array. Printing was conducted in a chamber with relative humidity set at 50%.

Slides containing maize sequences were purchased from Agilent Technology (Palo Alto, Calif. 94304).

Post-Processing of Slides

After arraying, slides were processed through a series of steps—rehydration, UV cross-linking, blocking and denaturation—required prior to hybridization. Slides were rehydrated by placing them over a beaker of warm water (DNA face down), for 2-3 sec, to distribute the DNA more evenly within the spots, and then snap dried on a hot plate (DNA side, face up). The DNA was then cross-linked to the slides by UV irradiation (60-65 mJ; 2400 Stratalinker, Stratagene, La Jolla, Calif., USA).

Following this a blocking step was performed to modify remaining free lysine groups, and hence minimize their ability to bind labeled probe DNA. To achieve this the arrays were placed in a slide rack. An empty slide chamber was left ready on an orbital shaker. The rack was bent slightly inwards in the middle, to ensure the slides would not run into each other while shaking. The blocking solution was prepared as follows:

3×350-ml glass chambers (with metal tops) were set to one side, and a large round Pyrex dish with dH$_2$O was placed ready in the microwave. At this time, 15 ml sodium borate was prepared in a 50 ml conical tube.

6-g succinic anhydride was dissolved in approx. 325-350 mL 1-methyl-2-pyrrolidinone. Rapid addition of reagent was crucial.
   a. Immediately after the last flake of the succinic anhydride dissolved, the 15-mL sodium borate was added.
   b. Immediately after the sodium borate solution mixed in, the solution was poured into an empty slide chamber.
   c. The slide rack was plunged rapidly and evenly in the solution. It was vigorously shaken up and down for a few seconds, making sure slides never left the solution.
   d. It was mixed on an orbital shaker for 15-20 min. Meanwhile, the water in the Pyrex dish (enough to cover slide rack) was heated to boiling.

Following this, the slide rack was gently plunge in the 95 C water (just stopped boiling) for 2 min. Then the slide rack was plunged 5× in 95% ethanol. The slides and rack were centrifuged for 5 min. @ 500 rpm. The slides were loaded quickly and evenly onto the carriers to avoid streaking. The arrays were used immediately or store in slide box.

The Hybridization process began with the isolation of mRNA from the two tissues (see "Isolation of total RNA" and "Isolation of mRNA", below) in question followed by their conversion to single stranded cDNA (see "Generation of probes for hybridization", below). The cDNA from each tissue was independently labeled with a different fluorescent dye and then both samples were pooled together. This final differentially labeled cDNA pool was then placed on a processed microarray and allowed to hybridize (see "Hybridization and wash conditions", below).

Isolation of Total RNA

Approximately 1 g of plant tissue was ground in liquid nitrogen to a fine powder and transferred into a 50-ml centrifuge tube containing 10 ml of Trizol reagent. The tube was vigorously vortexed for 1 min and then incubated at room temperature for 10-20 min on an orbital shaker at 220 rpm. Two ml of chloroform was added to the tube and the solution vortexed vigorously for at least 30-sec before again incubating at room temperature with shaking. The sample was then centrifuged at 12,000×g (10,000 rpm) for 15-20 min at 4° C. The aqueous layer was removed and mixed by inversion with 2.5 ml of 1.2 M NaCl/0.8 M Sodium Citrate and 2.5 ml of isopropyl alcohol added. After a 10 min incubation at room temperature, the sample was centrifuged at 12,000×g (10,000 rpm) for 15 min at 4° C. The pellet was washed with 70% ethanol, re-centrifuged at 8,000 rpm for 5 min and then air dried at room temperature for 10 min. The resulting total RNA was dissolved in either TE (10 mM Tris-HCl, 1 mM EDTA, pH 8.0) or DEPC (diethylpyrocarbonate) treated deionized water (RNAse-free water). For subsequent isolation of mRNA using the Qiagen kit, the total RNA pellet was dissolved in RNAse-free water.

Isolation of mRNA mRNA was isolated using the Qiagen Oligotex mRNA Spin-Column protocol (Qiagen, Valencia, Calif.). Briefly, 500 μl OBB buffer (20 mM Tris-Cl, pH 7.5, 1 M NaCl, 2 mM EDTA, 0.2% SDS) was added to 500 μl of total RNA (0.5-0.75 mg) and mixed thoroughly. The sample was first incubated at 70° C. for 3 min, then at room temperature for 10 minutes and finally centrifuged for 2 min at 14,000-18,000×g. The pellet was resuspended in 400 μl OW2 buffer (10 mM Tris-Cl, pH 7.5, 150 mM NaCl, 1 mM EDTA) by vortexing, the resulting solution placed on a small spin column in a 1.5 ml RNase-free microcentrifuge tube and centrifuged for 1 min at 14,000-18,000×g. The spin column was transferred to a new 1.5 ml RNase-free microcentrifuge tube and washed with 400 µl of OW2 buffer. To release the isolated mRNA from the resin, the spin column was again transferred to a new RNase-free 1.5 ml microcentrifuge tube, 20-100 µl 70° C. OEB buffer (5 mM Tris-Cl, pH 7.5) added and the resin resuspended in the resulting solution via pipeting. The mRNA solution was collected after centrifuging for 1 min at 14,000-18,000×g.

Alternatively, mRNA was isolated using the Stratagene Poly(A) Quik mRNA Isolation Kit (Startagene, La Jolla, Calif.). Here, up to 0.5 mg of total RNA (maximum volume of 1 ml) was incubated at 65° C. for 5 minutes, snap cooled on ice and 0.1× volumes of 10× sample buffer (10 mM Tris-HCl (pH 7.5), 1 mM EDTA (pH 8.0) 5 M NaCl) added. The RNA sample was applied to a prepared push column and passed through the column at a rate of ~1 drop every 2 sec. The solution collected was reapplied to the column and collected as above. 200 µl of high salt buffer (10 mM Tris-HCl (pH 7.5), 1 mM EDTA, 0.5 NaCl) was applied to the column and passed through the column at a rate of ~1 drop every 2 sec. This step was repeated and followed by three low salt buffer (10 mM Tris-HCl (pH 7.5), 1 mM EDTA, 0.1 M NaCl) washes preformed in a similar manner mRNA was eluted by applying to the column four separate 200 µl aliquots of elution buffer (10 mM Tris-HCl (pH 7.5), 1 mM EDTA) preheated to 65° C. Here, the elution buffer was passed through the column at a rate of 1 drop/sec. The resulting mRNA solution was precipitated by adding 0.1× volumes of 10× sample buffer, 2,5 volumes of ice-cold 100% ethanol, incubating overnight at −20° C. and centrifuging at 14,000-18,000×g for 20-30 min at 4° C. The pellet was washed with 70% ethanol and air dried for 10 min. at room temperature before resuspension in RNase-free deionized water.

Preparation of Yeast Controls

Plasmid DNA was isolated from the following yeast clones using Qiagen filtered maxiprep kits (Qiagen, Valencia, Calif.): YAL022c(Fun26), YAL031c(Fun21), YBR032w, YDL131w, YDL182w, YDL194w, YDL196w, YDR050c and YDR116c. Plasmid DNA was linearized with either BsrBI (YAL022c(Fun26), YAL031c(Fun21), YDL131w, YDL182w, YDL194w, YDL196w, YDR050c) or AflIII (YBR032w, YDR116c) and isolated.

In Vitro Transcription of Yeast Clones

The following solution was incubated at 37° C. for 2 hours: 17 µl of isolated yeast insert DNA (1 µg), 20 µl 5× buffer, 10 µl 100 mM DTT, 2.5 µl (100 U) RNasin, 20 µl 2.5 mM (ea.) rNTPs, 2.7 µl (40U) SP6 polymerase and 27.8 µl RNase-free deionized water. 2 µl (2 U) Ampli DNase I was added and the incubation continued for another 15 min. 10 µl 5M NH$_4$OAC and 100 µl phenol:chloroform:isoamyl alcohol (25:24:1) were added, the solution vortexed and then centrifuged to separate the phases. To precipitate the RNA, 250 µl ethanol was added and the solution incubated at −20° C. for at least one hour. The sample was then centrifuged for 20 min at 4° C. at 14,000-18,000×g, the pellet washed with 500 µl of 70% ethanol, air dried at room temperature for 10 min and resuspended in 100 µl of RNase-free deionized water. The precipitation procedure was then repeated.

Alternatively, after the two-hour incubation, the solution was extracted with phenol/chloroform once before adding 0.1 volume 3M sodium acetate and 2.5 volumes of 100% ethanol. The solution was centrifuged at 15,000 rpm, 4° C. for 20 minutes and the pellet resuspended in RNase-free deionized water. The DNase I treatment was carried out at 37° C. for 30 minutes using 2 U of Ampli DNase I in the following reaction condition: 50 mM Tris-HCl (pH 7.5), 10 mM MgCl$_2$. The DNase I reaction was then stopped with the addition of NH$_4$OAC and phenol:chloroform:isoamyl alcohol (25:24:1), and RNA isolated as described above.

0.15-2.5 ng of the in vitro transcript RNA from each yeast clone were added to each plant mRNA sample prior to labeling to serve as positive (internal) probe controls.

Generation of Probes for Hybridization

Generation of Labeled Probes for Hybridization from First-Strand cDNA

Hybridization probes were generated from isolated mRNA using an Atlas™ Glass Fluorescent Labeling Kit (Clontech Laboratories, Inc., Palo Alto, Calif., USA). This entails a two step labeling procedure that first incorporates primary aliphatic amino groups during cDNA synthesis and then couples fluorescent dye to the cDNA by reaction with the amino functional groups. Briefly, 5 µg of oligo(dT)$_{18}$ primer was mixed with Poly A+ mRNA (1.5-2 µg mRNA isolated using the Qiagen Oligotex mRNA Spin-Column protocol or-the Stratagene Poly(A) Quik mRNA Isolation protocol (Stratagene, La Jolla, Calif., USA)) in a total volume of 25 The sample was incubated in a thermocycler at 70° C. for 5 min, cooled to 48° C. and 10 µl of 5×cDNA Synthesis Buffer (kit supplied), 5 µl 10×dNTP mix (dATP, dCTP, dGTP, dTTP and aminoallyl-dUTP; kit supplied), 7.5 µl deionized water and 2.5 µl MMLV Reverse Transcriptase (500U) added. The reaction was then incubated at 48° C. for 30 minutes, followed by 1 hr incubation at 42° C. At the end of the incubation the reaction was heated to 70° C. for 10 min, cooled to 37° C. and 0.5 µl (5 U) RNase H added, before incubating for 15 min at 37° C. The solution was vortexed for 1 min after the addition of 0.5 µl 0.5 M EDTA and 5 µl of QuickClean Resin (kit supplied) then centrifuged at 14,000-18,000×g for 1 min. After removing the supernatant to a 0.45 µm spin filter (kit supplied), the sample was again centrifuged at 14,000-18,000×g for 1 min, and 5.5 µl 3 M sodium acetate and 137.5 µl of 100% ethanol added to the sample before incubating at −20° C. for at least 1 hr. The sample was then centrifuged at 14,000-18,000×g at 4° C. for 20 min, the resulting pellet washed with 500 µl70% ethanol, air-dried at room temperature for 10 min and resuspended in 10 µl of 2× fluorescent labeling buffer (kit provided). 10 µl each of the fluorescent dyes Cy3 and Cy5 (Amersham Pharmacia (Piscataway, N. J., USA); prepared according to Atlas™ kit directions of Clontech) were added and the sample incubated in the dark at room temperature for 30 min.

The fluorescently labeled first strand cDNA was precipitated by adding 2 µl 3M sodium acetate and 50 µl 100% ethanol, incubated at −20° C. for at least 2 hrs, centrifuged at 14,000-18,000×g for 20 min, washed with 70% ethanol, air-dried for 10 min and dissolved in 100 µl of water.

Alternatively, 3-4 µg mRNA, 2.5 (~8.9 ng of in vitro translated mRNA) p1 yeast control and 3 µg oligo were mixed in a total volume of 24.7 µl. The sample was incubated in a thermocycler at 70° C. for 10 min. before chilling on ice. To this, 8 µl of 5× first strand buffer (SuperScript II RNase H-Reverse Transcriptase kit from Invitrogen (Carlsbad, Calif. 92008); cat no. 18064022), 0.8° C. of aa-dUTP/dNTP mix (50×; 25 mM dATP, 25 mM dGTP, 25 mM dCTP, 15 mM dTTP, 10 mM aminoallyl-dUTP), 4 µl of 0.1 M DTT and 2.5 µl (500 units) of Superscript R.T.II enzyme (Stratagene) were added. The sample was incubated at 42° C. for 2 hours before a mixture of 10° C. of 1M NaOH and 10° C. of 0.5 M EDTA were added. After a 15 minute incubation at 65° C., 25 µl of 1 M Tris pH 7.4 was added. This was mixed with 450 µl of water in a Microcon 30 column before centrifugation at 11,000×g for 12 min. The column was washed twice with 450 µl (centrifugation at 11,000 g, 12 min.) before eluting the sample by inverting the Microcon column and centrifuging at 11,000×g for 20 seconds. Sample was dehydrated by centrifugation under vacuum and stored at −20° C.

Each reaction pellet was dissolved in 9 µl of 0.1 M carbonate buffer (0.1M sodium carbonate and sodium bicarbonate, pH=8.5-9) and 4.5 µl of this placed in two microfuge tubes. 4.5 µl of each dye (in DMSO) were added and the mixture incubated in the dark for 1 hour. 4.5 µl of 4 M hydroxylamine was added and again incubated in the dark for 15 minutes.

Regardless of the method used for probe generation, the probe was purified using a Qiagen PCR cleanup kit (Qiagen, Valencia, Calif., USA), and eluted with 100 ul EB (kit provided). The sample was loaded on a Microcon YM-30 (Millipore, Bedford, Mass., USA) spin column and concentrated to 4-5 ul in volume. Probes for the maize microarrays were generated using the Fluorescent Linear Amplification Kit (cat. No. G2556A) from Agilent Technologies (Palo Alto, Calif.).

Hybridization and Wash Conditions
The following Hybridization and Washing Condition were developed:
Hybridization Conditions:
Labeled probe was heated at 95° C. for 3 min and chilled on ice. Then 25 □L of the hybridization buffer which was warmed at 42 C was added to the probe, mixing by pipeting, to give a final concentration of:
50% formamide
 4×SSC
 0.03% SDS
5×Denhardt's solution
0.1 µg/ml single-stranded salmon sperm DNA The probe was kept at 42 C. Prior to the hybridization, the probe was heated for 1 more min, added to the array, and then covered with a glass cover slip. Slides were placed in hybridization chambers (Telechem, Sunnyvale, Calif.) and incubated at 42° C. overnight.

Washing Conditions:
A. Slides were washed in 1×SSC+0.03% SDS solution at room temperature for 5 minutes,
B. Slides were washed in 0.2×SSC at room temperature for 5 minutes,
C. Slides were washed in 0.05×SSC at room temperature for 5 minutes.

After A, B, and C, slides were spun at 800×g for 2 min. to dry. They were then scanned.

Maize microarrays were hybridized according to the instructions included Fluorescent Linear Amplification Kit (cat. No. G2556A) from Agilent Technologies (Palo Alto, Calif.).

Scanning of Slides
The chips were scanned using a ScanArray 3000 or 5000 (General Scanning, Watertown, Mass., USA). The chips were scanned at 543 and 633 nm, at 10 urn resolution to measure the intensity of the two fluorescent dyes incorporated into the samples hybridized to the chips.

Data Extraction and Analysis
The images generated by scanning slides consisted of two 16-bit TIFF images representing the fluorescent emissions of the two samples at each arrayed spot. These images were then quantified and processed for expression analysis using the data extraction software Imagene™ (Biodiscovery, Los Angeles, Calif., USA). Imagene output was subsequently analyzed using the analysis program Genespring™ (Silicon Genetics, San Carlos, Calif., USA). In Genespring, the data was imported using median pixel intensity measurements derived from Imagene output. Background subtraction, ratio calculation and normalization were all conducted in Genespring. Normalization was achieved by breaking the data in to 32 groups, each of which represented one of the 32 pin printing regions on the microarray. Groups consist of 360 to 550 spots. Each group was independently normalized by setting the median of ratios to one and multiplying ratios by the appropriate factor.

Results
The results of the microaray experiments are set forth in Table 1 in the section entitled "Microarray Data" which shows the results of the differential expression experiments for the mRNAs, as reported by their corresponding cDNA ID number, that were differentially transcribed under a particular set of conditions as compared to a control sample. The cDNA ID numbers correspond to those utilized. Increases in mRNA abundance levels in experimental plants versus the controls are denoted with the plus sign (+). Likewise, reductions in mRNA abundance levels in the experimental plants are denoted with the minus (−) sign.

The Table 1 section entitled "Microarray Data" is organized according to the clone number with each set of experimental conditions being denoted by the term "Expt Rep ID:" followed by a "short name". The row titled "Microarray Experiment Parameters" links each "short name" with a short description of the experiment and the parameters.

The sequences showing differential expression in a particular experiment (denoted by either a "+" or "−" in the column in Table 1 entitled "SIGNCLOG_RATIO") thereby show utility for a function in a plant, and these functions/utilities are described in detail below, where the title of each section (i.e. a "utility section") is correlated with the particular differential expression experiment in the section of Table 1 entitled "Microarray Experiment Parameters".

Organ-Affecting Genes, Gene Components, Products (Including Differentiation and Function)
Root Genes
The economic values of roots arise not only from harvested adventitious roots or tubers, but also from the ability of roots to funnel nutrients to support growth of all plants and increase their vegetative material, seeds, fruits, etc. Roots have four main functions. First, they anchor the plant in the soil. Second, they facilitate and regulate the molecular signals and molecular traffic between the plant, soil, and soil fauna. Third, the root provides a plant with nutrients gained from the soil or growth medium. Fourth, they condition local soil chemical and physical properties.

Root genes are active or potentially active to a greater extent in roots than in most other organs of the plant. These genes and gene products can regulate many plant traits from yield to stress tolerance. Root genes can be used to modulate root growth and development.

Differential Expression of the Sequences in Roots
The relative levels of mRNA product in the root versus the aerial portion of the plant was measured. Specifically, mRNA was isolated from roots and root tips of *Arabidopsis* plants and compared to mRNA isolated from the aerial portion of the plants utilizing microarray procedures.

Root Hair Genes, Gene Components And Products
Root hairs are specialized outgrowths of single epidermal cells termed trichoblasts. In many and perhaps all species of plants, the trichoblasts are regularly arranged around the perimeter of the root. In *Arabidopsis*, for example, trichoblasts tend to alternate with non-hair cells or atrichoblasts. This spatial patterning of the root epidermis is under genetic control, and a variety of mutants have been isolated in which this spacing is altered or in which root hairs are completely absent.

The root hair development genes of the instant invention are useful to modulate one or more processes of root hair structure and/or function including (1) development; (2) interaction with the soil and soil contents; (3) uptake and transport in the plant; and (4) interaction with microorganisms.

1.) Development

The surface cells of roots can develop into single epidermal cells termed trichoblasts or root hairs. Some of the root hairs will persist for the life of the plant; others will gradually die back; some may cease to function due to external influences. These genes and gene products can be used to modulate root hair density or root hair growth; including rate, timing, direction, and size, for example. These genes and gene products can also be used to modulate cell properties such as cell size, cell division, rate and direction and number, cell elongation, cell differentiation, lignified cell walls, epidermal cells (including trichoblasts) and root apical meristem cells (growth and initiation); and root hair architecture such as leaf cells under the trichome, cells forming the base of the trichome, trichome cells, and root hair responses. In addition these genes and gene products can be used to modulate one or more of the growth and development processes in response to internal plant programs or environmental stimuli in, for example, the seminal system, nodal system, hormone responses, Auxin, root cap abscission, root senescence, gravitropism, coordination of root growth and development with that of other organs (including leaves, flowers, seeds, fruits, and stems), and changes in soil environment (including water, minerals, Ph, and microfauna and flora).

2.) Interaction with Soil and Soil Contents

Root hairs are sites of intense chemical and biological activity and as a result can strongly modify the soil they contact. Roots hairs can be coated with surfactants and mucilage to facilitate these activities. Specifically, roots hairs are responsible for nutrient uptake by mobilizing and assimilating water, reluctant ions, organic and inorganic compounds and chemicals. In addition, they attract and interact with beneficial microfauna and flora. Root hairs also help to mitigate the effects of toxic ions, pathogens and stress. Thus, root hair genes and gene products can be used to modulate traits such as root hair surfactant and mucilage (including composition and secretion rate and time); nutrient uptake (including water, nitrate and other sources of nitrogen, phosphate, potassium, and micronutrients (e.g. iron, copper, etc.); microbe and nematode associations (such as bacteria including nitrogen-fixing bacteria, mycorrhizae, nodule-forming and other nematodes, and nitrogen fixation); oxygen transpiration; detoxification effects of iron, aluminum, cadmium, mercury, salt, and other soil constituents; pathogens (including chemical repellents) glucosinolates (GSL1), which release pathogen-controlling isothiocyanates; and changes in soil (such as Ph, mineral excess and depletion), and rhizosheath.

3.) Transport of Materials in Plants

Uptake of the nutrients by the root and root hairs contributes a source-sink effect in a plant. The greater source of nutrients, the more sinks, such as stems, leaves, flowers, seeds, fruits, etc. can draw sustenance to grow. Thus, root hair development genes and gene products can be used to modulate the vigor and yield of the overall plant as well as distinct cells, organs, or tissues of a plant. The genes and gene products, therefore, can modulate plant nutrition, growth rate (such as whole plant, including height, flowering time, etc., seedling, coleoptile elongation, young leaves, stems, flowers, seeds and fruit) and yield, including biomass (fresh and dry weight during any time in plant life, including maturation and senescence), number of flowers, number of seeds, seed yield, number, size, weight and harvest index (content and composition, e g amino acid, jasmonate, oil, protein and starch) and fruit yield (number, size, weight, harvest index, and post harvest quality).

Reproduction Genes, Gene Components and Products

Reproduction genes are defined as genes or components of genes capable of modulating any aspect of sexual reproduction from flowering time and inflorescence development to fertilization and finally seed and fruit development. These genes are of great economic interest as well as biological importance. The fruit and vegeTable industry grosses over 1 billion USD a year. The seed market, valued at approximately 15 billion USD annually, is even more lucrative.

Inflorescence and Floral Development Genes, Gene Components and Products

During reproductive growth the plant enters a program of floral development that culminates in fertilization, followed by the production of seeds. Senescence may or may not follow. The flower formation is a precondition for the sexual propagation of plants and is therefore essential for the propagation of plants that cannot be propagated vegetatively as well as for the formation of seeds and fruits. The point of time at which the merely vegetative growth of plants changes into flower formation is of vital importance for example in agriculture, horticulture and plant breeding. Also the number of flowers is often of economic importance, for example in the case of various useful plants (tomato, cucumber, zucchini, cotton etc.) with which an increased number of flowers may lead to an increased yield, or in the case of growing ornamental plants and cut flowers.

Flowering plants exhibit one of two types of inflorescence architecture: indeterminate, in which the inflorescence grows indefinitely, or determinate, in which a terminal flower is produced. Adult organs of flowering plants develop from groups of stem cells called meristems. The identity of a meristem is inferred from structures it produces: vegetative meristems give rise to roots and leaves, inflorescence meristems give rise to flower meristems, and flower meristems give rise to floral organs such as sepals and petals. Not only are meristems capable of generating new meristems of different identity, but their own identity can change during development. For example, a vegetative shoot meristem can be transformed into an inflorescence meristem upon floral induction, and in some species, the inflorescence meristem itself will eventually become a flower meristem. Despite the importance of meristem transitions in plant development, little is known about the underlying mechanisms.

Following germination, the shoot meristem produces a series of leaf meristems on its flanks. However, once floral induction has occurred, the shoot meristem switches to the production of flower meristems. Flower meristems produce floral organ primordia, which develop individually into sepals, petals, stamens or carpels. Thus, flower formation can be thought of as a series of distinct developmental steps, i.e. floral induction, the formation of flower primordia and the production of flower organs. Mutations disrupting each of the steps have been isolated in a variety of species, suggesting that a genetic hierarchy directs the flowering process (see for review, Weigel and Meyerowitz, In Molecular Basis of Morphogenesis (ed. M. Bernfield). 51st Annual Symposium of the Society for Developmental Biology, pp. 93-107, New York, 1993).

Expression of many reproduction genes and gene products is orchestrated by internal programs or the surrounding environment of a plant. These genes can be used to modulate traits such as fruit and seed yield Seed and Fruit Development Genes, Gene Components and Products The ovule is the primary female sexual reproductive organ of flowering plants. At maturity it contains the egg cell and one large central cell containing two polar nuclei encased by two integuments that, after fertilization, develops into the embryo, endosperm, and seed coat of the mature seed, respectively. As the ovule develops into the seed, the ovary matures into the fruit or silique. As such, seed and fruit development requires the orchestrated transcription of numerous polynucleotides, some of which are ubiquitous, others that are embryo-specific and still others that are expressed only in the endosperm, seed coat, or fruit. Such genes are termed fruit development responsive genes and can be used to modulate seed and fruit growth and development such as seed size, seed yield, seed composition and seed dormancy.

Differential Expression of the Sequences in Siliques, Inflorescences and Flowers The relative levels of mRNA product in the siliques relative to the plant as a whole was measured.

Differential Expression of the Sequences in Hybrid Seed Development

The levels of mRNA product in the seeds relative to those in a leaf and floral stems was measured.

Development Genes, Gene Components and Products

Imbibition and Germination Responsive Genes, Gene Components and Products

Seeds are a vital component of the world's diet. Cereal grains alone, which comprise ~90% of all cultivated seeds, contribute up to half of the global per capita energy intake. The primary organ system for seed production in flowering plants is the ovule. At maturity, the ovule consists of a haploid female gametophyte or embryo sac surrounded by several layers of maternal tissue including the nucleus and the integuments. The embryo sac typically contains seven cells including the egg cell, two synergids, a large central cell containing two polar nuclei, and three antipodal cells. That pollination results in the fertilization of both egg and central cell. The fertilized egg develops into the embryo. The fertilized central cell develops into the endosperm. And the integuments mature into the seed coat. As the ovule develops into the seed, the ovary matures into the fruit or silique. Late in development, the developing seed ends a period of extensive biosynthetic and cellular activity and begins to desiccate to complete its development and enter a dormant, metabolically quiescent state. Seed dormancy is generally an undesirable characteristic in agricultural crops, where rapid germination and growth are required. However, some degree of dormancy is advantageous, at least during seed development. This is particularly true for cereal crops because it prevents germination of grains while still on the ear of the parent plant (preharvest sprouting), a phenomenon that results in major losses to the agricultural industry. Extensive domestication and breeding of crop species have ostensibly reduced the level of dormancy mechanisms present in the seeds of their wild ancestors, although under some adverse environmental conditions, dormancy may reappear. By contrast, weed seeds frequently mature with inherent dormancy mechanisms that allow some seeds to persist in the soil for many years before completing germination.

Germination commences with imbibition, the uptake of water by the dry seed, and the activation of the quiescent embryo and endosperm. The result is a burst of intense metabolic activity. At the cellular level, the genome is transformed from an inactive state to one of intense transcriptional activity. Stored lipids, carbohydrates and proteins are catabolized fueling seedling growth and development. DNA and organelles are repaired, replicated and begin functioning. Cell expansion and cell division are triggered. The shoot and root apical meristem are activated and begin growth and organogenesis. Schematic 4 summarizes some of the metabolic and cellular processes that occur during imbibition. Germination is complete when a part of the embryo, the radicle, extends to penetrate the structures that surround it. In *Arabidopsis*, seed germination takes place within twenty-four (24) hours after imbibition. As such, germination requires the rapid and orchestrated transcription of numerous polynucleotides. Germination is followed by expansion of the hypocotyl and opening of the cotyledons. Meristem development continues to promote root growth and shoot growth, which is followed by early leaf formation.

Imbibition and Germination Genes

Imbibition and germination includes those events that commence with the uptake of water by the quiescent dry seed and terminate with the expansion and elongation of the shoots and roots. The germination period exists from imbibition to when part of the embryo, usually the radicle, extends to penetrate the seed coat that surrounds it. Imbibition and germination genes are defined as genes, gene components and products capable of modulating one or more processes of imbibition and germination described above. They are useful to modulate many plant traits from early vigor to yield to stress tolerance.

Differential Expression of the Sequences in Germinating Seeds and Imbibed Embryos The levels of mRNA product in the seeds versus the plant as a whole was measured.

Hormone Responsive Genes, Gene Components and Products

Abscissic Acid Responsive Genes, Gene Components and Products

Plant hormones are naturally occurring substances, effective in very small amounts, which act as signals to stimulate or inhibit growth or regulate developmental processes in plants. Abscisic acid (ABA) is a ubiquitous hormone in vascular plants that has been detected in every major organ or living tissue from the root to the apical bud. The major physiological responses affected by ABA are dormancy, stress stomatal closure, water uptake, abscission and senescence. In contrast to Auxins, cytokinins and gibberellins, which are principally growth promoters, ABA primarily acts as an inhibitor of growth and metabolic processes.

Changes in ABA concentration internally or in the surrounding environment in contact with a plant results in modulation of many genes and gene products. These genes and/or products are responsible for effects on traits such as plant vigor and seed yield. While ABA responsive polynucleotides and gene products can act alone, combinations of these polynucleotides also affect growth and development. Useful combinations include different ABA responsive polynucleotides and/or gene products that have similar transcription profiles or similar biological activities, and members of the same or similar biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants. In addition, the combination of an ABA responsive polynucleotide and/or gene product with another environmentally responsive polynucleotide is also useful because of the interactions that exist between hormone-regulated pathways, stress and defense induced pathways, nutritional pathways and development.

Differential Expression of the Sequences in ABA Treated Plants

The relative levels of mRNA product in plants treated with ABA versus controls treated with water were measured.

Brassinosteroid Responsive Genes, Gene Components and Products

Plant hormones are naturally occurring substances, effective in very small amounts, which act as signals to stimulate or inhibit growth or regulate developmental processes in plants. Brassinosteroids (BRs) are the most recently discovered, and least studied, class of plant hormones. The major physiological response affected by BRs is the longitudinal growth of young tissue via cell elongation and possibly cell division. Consequently, disruptions in BR metabolism, perception and activity frequently result in a dwarf phenotype. In addition, because BRs are derived from the sterol metabolic pathway, any perturbations to the sterol pathway can affect the BR pathway. In the same way, perturbations in the BR pathway can have effects on the later part of the sterol pathway and thus the sterol composition of membranes.

Changes in BR concentration in the surrounding environment or in contact with a plant result in modulation of many genes and gene products. These genes and/or products are responsible for effects on traits such as plant biomass and seed yield. These genes were discovered and characterized from a much larger set of genes by experiments designed to find genes whose mRNA abundance changed in response to application of BRs to plants.

While BR responsive polynucleotides and gene products can act alone, combinations of these polynucleotides also affect growth and development. Useful combinations include different BR responsive polynucleotides and/or gene products that have similar transcription profiles or similar biological activities, and members of the same or functionally related biochemical pathways. Whole pathways or segments of pathways are controlled by transcription factors and proteins controlling the activity of signal transduction pathways. Therefore, manipulation of such protein levels is especially useful for altering phenotypes and biochemical activities of plants. In addition, the combination of a BR responsive polynucleotide and/or gene product with another environmentally responsive polynucleotide is useful because of the interactions that exist between hormone-regulated pathways, stress pathways, nutritional pathways and development. Here, in addition to polynucleotides having similar transcription profiles and/or biological activities, useful combinations include polynucleotides that may have different transcription profiles but which participate in common or overlapping pathways.

Differential Expression of the Sequences in Epi-Brassinolide or Brassinozole Plants The relative levels of mRNA product in plants treated with either epi-brassinolide or brassinozole were measured.

Metabolism Affecting Genes, Gene Components and Products

Nitrogen Responsive Genes, Gene Components and Products

Nitrogen is often the rate-limiting element in plant growth, and all field crops have a fundamental dependence on exogenous nitrogen sources. Nitrogenous fertilizer, which is usually supplied as ammonium nitrate, potassium nitrate, or urea, typically accounts for 40% of the costs associated with crops, such as corn and wheat in intensive agriculture. Increased efficiency of nitrogen use by plants should enable the production of higher yields with existing fertilizer inputs and/or enable existing yields of crops to be obtained with lower fertilizer input, or better yields on soils of poorer quality. Also, higher amounts of proteins in the crops could also be produced more cost-effectively. "Nitrogen responsive" genes and gene products can be used to alter or modulate plant growth and development.

Differential Expression of the Sequences in Whole Seedlings, Shoots and Roots

The relative levels of mRNA product in whole seedlings, shoots and roots treated with either high or low nitrogen media were compared to controls.

Viability Genes, Gene Components and Products

Plants contain many proteins and pathways that when blocked or induced lead to cell, organ or whole plant death. Gene variants that influence these pathways can have profound effects on plant survival, vigor and performance. The critical pathways include those concerned with metabolism and development or protection against stresses, diseases and pests. They also include those involved in apoptosis and necrosis. Viability genes can be modulated to affect cell or plant death.

Herbicides are, by definition, chemicals that cause death of tissues, organs and whole plants. The genes and pathways that are activated or inactivated by herbicides include those that cause cell death as well as those that function to provide protection.

Differential Expression of the Sequences in Herbicide Treated Plants and Herbicide Resistant Mutants The relative levels of mRNA product in plants treated with herbicide and mutants resistant to herbicides were compared to control plants.

Stress Responsive Genes, Gene Components and Products

Wounding Responsive Genes, Gene Components and Products

Plants are continuously subjected to various forms of wounding from physical attacks including the damage created by pathogens and pests, wind, and contact with other objects. Therefore, survival and agricultural yields depend on constraining the damage created by the wounding process and inducing defense mechanisms against future damage.

Plants have evolved complex systems to minimize and/or repair local damage and to minimize subsequent attacks by pathogens or pests or their effects. These involve stimulation of cell division and cell elongation to repair tissues, induction of programmed cell death to isolate the damage caused mechanically and by invading pests and pathogens, and induction of long-range signaling systems to induce protecting molecules, in case of future attack. The genetic and biochemical systems associated with responses to wounding are connected with those associated with other stresses such as pathogen attack and drought.

Wounding responsive genes and gene products can be used to alter or modulate traits such as growth rate; whole plant height, width, or flowering time; organ development (such as coleoptile elongation, young leaves, roots, lateral roots, tuber formation, flowers, fruit, and seeds); biomass; fresh and dry weight during any time in plant life, such as at maturation; number of flowers; number of seeds; seed yield, number, size, weight, harvest index (such as content and composition, e.g., amino acid, nitrogen, oil, protein, and carbohydrate); fruit yield, number, size, weight, harvest index, post harvest quality, content and composition (e.g., amino acid, carotenoid, jasmonate, protein, and starch); seed and fruit development; germination of dormant and non-dormant seeds; seed viability, seed reserve mobilization, fruit ripening, initiation of the reproductive cycle from a vegetative state, flower development time, insect attraction for fertilization, time to fruit maturity, senescence; fruits, fruit drop; leaves; stress and disease responses; drought; heat and cold; wounding by any source, including wind, objects, pests and pathogens; uv and high light damage (insect, fungus, virus, worm, nematode damage).

Cold Responsive Genes, Gene Components and Products

The ability to endure low temperatures and freezing is a major determinant of the geographical distribution and productivity of agricultural crops. Even in areas considered suiTable for the cultivation of a given species or cultivar, can give rise to yield decreases and crop failures as a result of aberrant, freezing temperatures. Even modest increases (1-2° C.) in the freezing tolerance of certain crop species would have a dramatic impact on agricultural productivity in some areas. The development of genotypes with increased freezing tolerance would provide a more reliable means to minimize crop losses and diminish the use of energy-costly practices to modify the microclimate.

Sudden cold temperatures result in modulation of many genes and gene products, including promoters. These genes and/or products are responsible for effects on traits such as plant vigor and seed yield.

Manipulation of one or more cold responsive gene activities is useful to modulate growth and development.

Differential Expression of the Sequences in Cold Treated Plants

The relative levels of mRNA product in cold treated plants were compared to control plants.

Heat Responsive Genes, Gene Components and Products

The ability to endure high temperatures is a major determinant of the geographical distribution and productivity of agricultural crops. Decreases in yield and crop failure frequently occur as a result of aberrant, hot conditions even in areas considered suiTable for the cultivation of a given species or cultivar. Only modest increases in the heat tolerance of crop species would have a dramatic impact on agricultural productivity. The development of genotypes with increased heat tolerance would provide a more reliable means to minimize crop losses and diminish the use of energy-costly practices to modify the microclimate.

Changes in temperature in the surrounding environment or in a plant microclimate results in modulation of many genes and gene products.

Differential Expression of the Sequences in Heat Treated Plants

The relative levels of mRNA product in heat treated plants were compared to control plants.

Drought Responsive Genes, Gene Components and Products

The ability to endure drought conditions is a major determinant of the geographical distribution and productivity of agricultural crops. Decreases in yield and crop failure frequently occur as a result of aberrant, drought conditions even in areas considered suiTable for the cultivation of a given species or cultivar. Only modest increases in the drought tolerance of crop species would have a dramatic impact on agricultural productivity. The development of genotypes with increased drought tolerance would provide a more reliable means to minimize crop losses and diminish the use of energy-costly practices to modify the microclimate.

Drought conditions in the surrounding environment or within a plant, results in modulation of many genes and gene products.

Differential Expression of the Sequences in Drought Treated Plants and Drought Mutants The relative levels of mRNA product in drought treated plants and drought mutants were compared to control plants.

Methyl Jasmonate (Jasmonate) Responsive Genes, Gene Components and Products

Jasmonic acid and its derivatives, collectively referred to as jasmonates, are naturally occurring derivatives of plant lipids. These substances are synthesized from linolenic acid in a lipoxygenase-dependent biosynthetic pathway. Jasmonates are signalling molecules which have been shown to be growth regulators as well as regulators of defense and stress responses. As such, jasmonates represent a separate class of plant hormones. Jasmonate responsive genes can be used to modulate plant growth and development.

Differential Expression of the Sequences in Methyl Jasmonate Treated Plants

The relative levels of mRNA product in methyl jasmonate treated plants were compared to control plants.

Salicylic Acid Responsive Genes, Gene Components and Products

Plant defense responses can be divided into two groups: constitutive and induced. Salicylic acid (SA) is a signaling molecule necessary for activation of the plant induced defense system known as systemic acquired resistance or SAR. This response, which is triggered by prior exposure to avirulent pathogens, is long lasting and provides protection against a broad spectrum of pathogens. Another induced defense system is the hypersensitive response (HR). HR is far more rapid, occurs at the sites of pathogen (avirulent pathogens) entry and precedes SAR. SA is also the key signaling molecule for this defense pathway.

Differential Expression of the Sequences in Salicylic Acid Treated Plants

The relative levels of mRNA product in salicylic acid treated plants were compared to control plants.

Osmotic Stress Responsive Genes, Gene Components and Products

The ability to endure and recover from osmotic and salt related stress is a major determinant of the geographical distribution and productivity of agricultural crops. Osmotic stress is a major component of stress imposed by saline soil and water deficit. Decreases in yield and crop failure frequently occur as a result of aberrant or transient environmental stress conditions even in areas considered suitable for the cultivation of a given species or cultivar. Only modest increases in the osmotic and salt tolerance of a crop species would have a dramatic impact on agricultural productivity. The development of genotypes with increased osmotic tolerance would provide a more reliable means to minimize crop losses and diminish the use of energy-costly practices to modify the soil environment. Thus, osmotic stress responsive genes can be used to modulate plant growth and development.

Differential Expression of the Sequences in PEG Treated Plants

The relative levels of mRNA product in PEG treated plants were compared to control plants.

Shade Responsive Genes, Gene Components and Products

Plants sense the ratio of Red (R):Far Red (FR) light in their environment and respond differently to particular ratios. A low R:FR ratio, for example, enhances cell elongation and favors flowering over leaf production. The changes in R:FR ratios mimic and cause the shading response effects in plants. The response of a plant to shade in the canopy structures of agricultural crop fields influences crop yields significantly. Therefore manipulation of genes regulating the shade avoidance responses can improve crop yields. While phytochromes mediate the shade avoidance response, the down-stream factors participating in this pathway are largely unknown. One potential downstream participant, ATHB-2, is a member of the HD-Zip class of transcription factors and shows a strong and rapid response to changes in the R:FR ratio. ATHB-2 overexpressors have a thinner root mass, smaller and fewer leaves and longer hypocotyls and petioles. This elongation arises from longer epidermal and cortical cells, and a decrease in secondary vascular tissues, paralleling the changes observed in wild-type seedlings grown under conditions simulating canopy shade. On the other hand, plants with reduced ATHB-2 expression have a thick root mass and many larger leaves and shorter hypocotyls and petioles. Here, the changes in the hypocotyl result from shorter epidermal and cortical cells and increased proliferation of vascular tissue. Interestingly, application of Auxin is able to reverse the root phenotypic consequences of high ATHB-2 levels, restoring the wild-type phenotype. Consequently, given that ATHB-2 is tightly regulated by phytochrome, these data suggest that ATHB-2 may link the Auxin and phytochrome pathways in the shade avoidance response pathway.

Shade responsive genes can be used to modulate plant growth and development.

Differential Expression of the Sequences in Far-Red Light Treated Plants

The relative levels of mRNA product in far-red light treated plants were compared to control plants.

Viability Genes, Gene Components and Products

Plants contain many proteins and pathways that when blocked or induced lead to cell, organ or whole plant death. Gene variants that influence these pathways can have profound effects on plant survival, vigor and performance. The critical pathways include those concerned with metabolism and development or protection against stresses, diseases and pests. They also include those involved in apoptosis and necrosis. The applicants have elucidated many such genes and pathways by discovering genes that when inactivated lead to cell or plant death.

Herbicides are, by definition, chemicals that cause death of tissues, organs and whole plants. The genes and pathways that are activated or inactivated by herbicides include those that cause cell death as well as those that function to provide protection. The applicants have elucidated these genes.

The genes defined in this section have many uses including manipulating which cells, tissues and organs are selectively killed, which are protected, making plants resistant to herbicides, discovering new herbicides and making plants resistant to various stresses.

Viability genes were also identified from a much larger set of genes by experiments designed to find genes whose mRNA products changed in concentration in response to applications of different herbicides to plants. Viability genes are characteristically differentially transcribed in response to fluctuating herbicide levels or concentrations, whether internal or external to an organism or cell. The MA_diff Table reports the changes in transcript levels of various viability genes.

Early Seedling-Phase Specific Responsive Genes, Gene Components and Products

One of the more active stages of the plant life cycle is a few days after germination is complete, also referred to as the early seedling phase. During this period the plant begins development and growth of the first leaves, roots, and other organs not found in the embryo. Generally this stage begins when germination ends. The first sign that germination has been completed is usually that there is an increase in length and fresh weight of the radicle. Such genes and gene products can regulate a number of plant traits to modulate yield. For example, these genes are active or potentially active to a greater extent in developing and rapidly growing cells, tissues and organs, as exemplified by development and growth of a seedling 3 or 4 days after planting a seed.

Rapid, efficient establishment of a seedling is very important in commercial agriculture and horticulture. It is also vital that resources are approximately partitioned between shoot and root to facilitate adaptive growth. Phototropism and geotropism need to be established. All these require post-germination process to be sustained to ensure that vigorous seedlings are produced. Early seedling phase genes, gene components and products are useful to manipulate these and other processes.

Guard Cell Genes, Gene Components and Products

Scattered throughout the epidermis of the shoot are minute pores called stomata. Each stomal pore is surrounded by two guard cells. The guard cells control the size of the stomal pore, which is critical since the stomata control the exchange of carbon dioxide, oxygen, and water vapor between the interior of the plant and the outside atmosphere. Stomata open and close through turgor changes driven by ion fluxes, which occur mainly through the guard cell plasma membrane and tonoplast. Guard cells are known to respond to a number of external stimuli such as changes in light intensity, carbon dioxide and water vapor, for example. Guard cells can also sense and rapidly respond to internal stimuli including changes in ABA, auxin and calcium ion flux.

Thus, genes, gene products, and fragments thereof differentially transcribed and/or translated in guard cells can be useful to modulate ABA responses, drought tolerance, respiration, water potential, and water management as examples. All of which can in turn affect plant yield including seed yield, harvest index, fruit yield, etc.

To identify such guard cell genes, gene products, and fragments thereof, Applicants have performed a microarray experiment comparing the transcript levels of genes in guard cells versus leaves. Experimental data is shown below.

Nitric Oxide Responsive Genes, Gene Components and Products

The rate-limiting element in plant growth and yield is often its ability to tolerate suboptimal or stress conditions, including pathogen attack conditions, wounding and the presence of various other factors. To combat such conditions, plant cells deploy a battery of inducible defense responses, including synergistic interactions between nitric oxide (NO), reactive oxygen intermediates (ROS), and salicylic acid (SA). NO has been shown to play a critical role in the activation of innate immune and inflammatory responses in animals. At least part of this mammalian signaling pathway is present in plants, where NO is known to potentiate the hypersensitive response (HR). In addition, NO is a stimulator molecule in plant photomorphogenesis.

Changes in nitric oxide concentration in the internal or surrounding environment, or in contact with a plant, results in modulation of many genes and gene products.

In addition, the combination of a nitric oxide responsive polynucleotide and/or gene product with other environmentally responsive polynucleotides is also useful because of the interactions that exist between hormone regulated pathways, stress pathways, pathogen stimulated pathways, nutritional pathways and development.

Nitric oxide responsive genes and gene products can function either to increase or dampen the above phenotypes or activities either in response to changes in nitric oxide concentration or in the absence of nitric oxide fluctuations. More specifically, these genes and gene products can modulate stress responses in an organism. In plants, these genes and gene products are useful for modulating yield under stress conditions. Measurements of yield include seed yield, seed size, fruit yield, fruit size, etc.

Shoot-Apical Meristem Genes, Gene Components and Products

New organs, stems, leaves, branches and inflorescences develop from the stem apical meristem (SAM). The growth structure and architecture of the plant therefore depends on the behavior of SAMs. Shoot apical meristems (SAMs) are comprised of a number of morphologically undifferentiated, dividing cells located at the tips of shoots. SAM genes elucidated here are capable of modifying the activity of SAMs and thereby many traits of economic interest from ornamental leaf shape to organ number to responses to plant density.

In addition, a key attribute of the SAM is its capacity for self-renewal. Thus, SAM genes of the instant invention are useful for modulating one or more processes of SAM structure and/or function including (I) cell size and division; (II) cell differentiation and organ primordia. The genes and gene components of this invention are useful for modulating any one or all of these cell division processes generally, as in timing and rate, for example. In addition, the polynucleotides and polypeptides of the invention can control the response of these processes to the internal plant programs associated with embryogenesis, and hormone responses, for example.

Because SAMs determine the architecture of the plant, modified plants will be useful in many agricultural, horticultural, forestry and other industrial sectors. Plants with a different shape, numbers of flowers and seed and fruits will have altered yields of plant parts. For example, plants with more branches can produce more flowers, seed or fruits. Trees without lateral branches will produce long lengths of clean timber. Plants with greater yields of specific plant parts will be useful sources of constituent chemicals.

GFP Experimental Procedures and Results

Procedures

The polynucleotide sequences of the present invention were tested for promoter activity using Green Fluorescent Protein (GFP) assays in the following manner Approximately 1-2 kb of genomic sequence occurring immediately upstream of the ATG translational start site of the gene of interest was isolated using appropriate primers tailed with BstXI restriction sites. Standard PCR reactions using these primers and genomic DNA were conducted. The resulting product was isolated, cleaved with BstXI and cloned into the BstXI site of an appropriate vector, such as pNewBin4-HAP1-GFP (see FIG. 1).

Transformation

The following procedure was used for transformation of plants

1. Stratification of WS-2 Seed.
   Add 0.5 ml WS-2 (CS2360) seed to 50 ml of 0.2% Phytagar in a 50 ml Corning tube and vortex until seeds and Phytagar form a homogenous mixture.
   Cover tube with foil and stratify at 4° C. for 3 days.
2. Preparation of Seed Mixture.
   Obtain stratified seed from cooler.
   Add seed mixture to a 1000 ml beaker.
   Add an additional 950 ml of 0.2% Phytagar and mix to homogenize.
3. Preparation of Soil Mixture.
   Mix 24 L SunshineMix #5 soil with 16 L Therm-O-Rock vermiculite in cement mixer to make a 60:40 soil mixture.
   Amend soil mixture by adding 2 Tbsp Marathon and 3 Tbsp Osmocote and mix contents thoroughly.
   Add 1 Tbsp Peters fertilizer to 3 gallons of water and add to soil mixture and mix thoroughly.
   Fill 4-inch pots with soil mixture and round the surface to create a slight dome.
   Cover pots with 8-inch squares of nylon netting and fasten using rubber bands.
   Place 14 4-inch pots into each no-hole utility flat.
4. Planting.
   Using a 60 ml syringe, aspirate 35 ml of the seed mixture.
   Exude 25 drops of the seed mixture onto each pot.
   Repeat until all pots have been seeded.
   Place flats on greenhouse bench, cover flat with clear propagation domes, place 55% shade cloth on top of flats and subirrigate by adding 1 inch of water to bottom of each flat.
5. Plant Maintenance.
   3 to 4 days after planting, remove clear lids and shade cloth.
   Subirrigate flats with water as needed.
   After 7-10 days, thin pots to 20 plants per pot using forceps.
   After 2 weeks, subirrigate all plants with Peters fertilizer at a rate of 1 Tsp per gallon water.
   When bolts are about 5-10 cm long, clip them between the first node and the base of stem to induce secondary bolts.
   6 to 7 days after clipping, perform dipping infiltration.
6. Preparation of *Agrobacterium*.
   Add 150 ml fresh YEB to 250 ml centrifuge bottles and cap each with a foam plug (Identi-Plug).
   Autoclave for 40 min at 121° C.
   After cooling to room temperature, uncap and add 0.1 ml each of carbenicillin, spectinomycin and rifampicin stock solutions to each culture vessel.
   Obtain *Agrobacterium* starter block (96-well block with *Agrobacterium* cultures grown to an $OD_{600}$ of approximately 1.0) and inoculate one culture vessel per construct by transferring 1 ml from appropriate well in the starter block.
   Cap culture vessels and place on Lab-Line incubator shaker set at 27° C. and 250 RPM.
   Remove after *Agrobacterium* cultures reach an $OD_{600}$ of approximately 1.0 (about 24 hours), cap culture vessels with plastic caps, place in Sorvall SLA 1500 rotor and centrifuge at 8000 RPM for 8 min at 4° C.
   Pour out supernatant and put bottles on ice until ready to use.
   Add 200 ml Infiltration Media (IM) to each bottle, resuspend *Agrobacterium* pellets and store on ice.

7. Dipping Infiltration.
   Pour resuspended *Agrobacterium* into 16 oz polypropylene containers.
   Invert 4-inch pots and submerge the aerial portion of the plants into the *Agrobacterium* suspension and let stand for 5 min.
   Pour out *Agrobacterium* suspension into waste bucket while keeping polypropylene container in place and return the plants to the upright position.
   Place 10 covered pots per flat.
   Fill each flat with 1-inch of water and cover with shade cloth.
   Keep covered for 24 hr and then remove shade cloth and polypropylene containers.
   Resume normal plant maintenance.
   When plants have finished flowering cover each pot with a ciber plant sleeve.
   After plants are completely dry, collect seed and place into 2.0 ml micro tubes and store in 100-place cryogenic boxes.

Recipes:
0.2% Phytagar
   2 g Phytagar
   1 L nanopure water
      Shake until Phytagar suspended
      Autoclave 20 min
YEB (for 1 L)
   5 g extract of meat
   5 g Bacto peptone
   1 g yeast extract
   5 g sucrose
   0.24 g magnesium sulfate
      While stirring, add ingredients, in order, to 900 ml nanopure water
      When dissolved, adjust pH to 7.2
      Fill to 1 L with nanopure water
      Autoclave 35 min
Infiltration Medium (IM) (for 1 L)
   2.2 g MS salts
   50 g sucrose
   5 ul BAP solution (stock is 2 mg/ml)
      While stirring, add ingredients in order listed to 900 ml nanopure water
      When dissolved, adjust pH to 5.8.
      Volume up to 1 L with nanopure water.
      Add 0.02% Silwet L-77 just prior to resuspending *Agrobacterium*

High Throughput Screening—T1 Generation
1. Soil Preparation. Wear gloves at all times.
   In a large container, mix 60% autoclaved SunshineMix #5 with 40% vermiculite.
   Add 2.5 Tbsp of Osmocote, and 2.5 Tbsp of 1% granular Marathon per 25 L of soil.
   Mix thoroughly.
2. Fill Corn-Packs With Soil.
   Loosely fill D601 Corn-Packs level to the rim with the prepared soil.
   Place filled pot into utility flat with holes, within a no-hole utility flat.
   Repeat as necessary for planting. One flat set should contain 6 pots.
3. Saturate Soil.
   Evenly water all pots until the soil is saturated and water is collecting in the bottom of the flats.
   After the soil is completely saturated, dump out the excess water.
4. Plant the Seed.
5. Stratify the Seeds.
   After sowing the seed for all the flats, place them into a dark 4° C. cooler.
   Keep the flats in the cooler for 2 nights for WS seed. Other ecotypes may take longer. This cold treatment will help promote uniform germination of the seed.
6. Remove Flats From Cooler and Cover With Shade Cloth. (Shade cloth is only needed in the greenhouse)
   After the appropriate time, remove the flats from the cooler and place onto growth racks or benches.
   Cover the entire set of flats with 55% shade cloth. The cloth is necessary to cut down the light intensity during the delicate germination period.
   The cloth and domes should remain on the flats until the cotyledons have fully expanded. This usually takes about 4-5 days under standard greenhouse conditions.
7. Remove 55% Shade Cloth and Propagation Domes.
   After the cotyledons have fully expanded, remove both the 55% shade cloth and propagation domes.
8. Spray Plants With Finale Mixture. Wear gloves and protective clothing at all times.
   Prepare working Finale mixture by mixing 3 ml concentrated Finale in 48 oz of water in the Poly-TEK sprayer.
   Completely and evenly spray plants with a fine mist of the Finale mixture.
   Repeat Finale spraying every 3-4 days until only transformants remain (Approximately 3 applications are necessary.)
   When satisfied that only transformants remain, discontinue Finale spraying.
9. Weed Out Excess Transformants.
   Weed out excess transformants such that a maximum number of five plants per pot exist evenly spaced throughout the pot.
   GFP Assay
   Tissues are dissected by eye or under magnification using INOX 5 grade forceps and placed on a slide with water and coversliped. An attempt is made to record images of observed expression patterns at earliest and latest stages of development of tissues listed below. Specific tissues will be preceded with High (H), Medium (M), Low (L) designations.

| | |
|---|---|
| i Flower | i pedicel i receptacle i nectary i sepal i petal i filament i anther i pollen i carpel i style i papillae i vascular i epidermis i stomata i trichome |
| i Silique | i stigma i style i carpel i septum i placentae i transmitting tissue i vascular i epidermis i stomata i abscission zone i ovule |
| i Ovule | Pre-fertilization: i inner integument i outer integument i embryo sac i funiculus i chalaza i micropyle i gametophyte |
| | Post-fertilization: i zygote i inner integument i outer integument i seed coat i primordia i chalaza i micropyle i early endosperm i mature endosperm i embryo |
| i Embryo | i suspensor i preglobular i globular i heart i torpedo i late i mature i provascular i hypophysis i radicle i cotyledons i hypocotyl |

-continued

| ⁱ Stem | ⁱ epidermis ⁱ cortex ⁱ vascular ⁱ xylem ⁱ phloem ⁱ pith ⁱ stomata ⁱ trichome |
| ⁱ Leaf | ⁱ petiole ⁱ mesophyll ⁱ vascular ⁱ epidermis ⁱ trichome ⁱ primordia ⁱ stomata ⁱ stipule ⁱ margin |

T1 Mature: These are the T1 plants resulting from independent transformation events. These are screened between stage 6.50-6.90 (means the plant is flowering and that 50-90% of the flowers that the plant will make have developed) which is 4-6 weeks of age. At this stage the mature plant possesses flowers, siliques at all stages of development, and fully expanded leaves. We do not generally differentiate between 6.50 and 6.90 in the report but rather just indicate 6.50. The plants are initially imaged under UV with a Leica Confocal microscope. This allows examination of the plants on a global level. If expression is present, they are imaged using scanning laser confocal microcopy.

T2 Seedling: Progeny are collected from the T1 plants giving the same expression pattern and the progeny (T2) are sterilized and plated on agar-solidified medium containing M&S salts. In the event that there was no expression in the T1 plants, T2 seeds are planted from all lines. The seedlings are grown in Percival incubators under continuous light at 22° C. for 10-12 days. Cotyledons, roots, hypocotyls, petioles, leaves, and the shoot meristem region of individual seedlings were screened until two seedlings were observed to have the same pattern. Generally found the same expression pattern was found in the first two seedlings. However, up to 6 seedlings were screened before "no expression pattern" was recorded. All constructs are screened as T2 seedlings even if they did not have an expression pattern in the T1 generation.

T2 Mature: The T2 mature plants were screened in a similar manner to the T1 plants. The T2 seeds were planted in the greenhouse, exposed to selection and at least one plant screened to confirm the T1 expression pattern. In instances where there were any subtle changes in expression, multiple plants were examined and the changes noted in the tables.

T3 Seedling: This was done similar to the T2 seedlings except that only the plants for which we are trying to confirm the pattern are planted.

Image Data:

Images are collected by scanning laser confocal microscopy. Scanned images are taken as 2-D optical sections or 3-D images generated by stacking the 2-D optical sections collected in series. All scanned images are saved as TIFF files by imaging software, edited in Adobe Photoshop, and labeled in Powerpoint specifying organ and specific expressing tissues.

Instrumentation:
Microscope
Inverted Leica DM IRB
Fluorescence filter blocks:
Blue excitation BP 450-490; long pass emission LP 515.
Green excitation BP 515-560; long pass emission LP 590
Objectives
HC PL FLUOTAR 5x/0.5
HCPL APO 10x/0.4 IMM water/glycerol/oil
HCPL APO 20x/0.7 IMM water/glycerol/oil
HCXL APO 63x/1.2 IMM water/glycerol/oil
Leica TCS SP2 Confocal Scanner
Spectral range of detector optics 400-850 nm.
Variable computer controlled pinhole diameter.
Optical zoom 1-32x.
Four simultaneous detectors:
Three channels for collection of fluorescence or reflected light.
One channel for transmitted light detector.
Laser sources:
Blue Ar 458/5 mW, 476 nm/5 mW, 488 nm/20 mW, 514 nm/20 mW.
Green HeNe 543 nm/1.2 mW
Red HeNe 633 nm/10 mW
Results The section in Table 1 entitled "The spatial expression of the promoter-marker-vector" presents the results of the GFP assays as reported by their corresponding cDNA ID number, construct number and line number. Unlike the microarray results, which measure the difference in expression of the endogenous cDNA under various conditions, the GFP data gives the location of expression that is visible under the imaging parameters. Table 3 summarizes the results of the spatial expression results for each promoter.

Explanation of Table 1

Table 1 includes various information about each promoter or promoter control element of the invention including the nucleotide sequence, the spatial expression promoted by each promoter, and the corresponding results from different expression experiments.

TABLE 1

Promoter Sequences and Related Information
Promoter YP0384

Modulates the gene: Heat shock transcription factor family.

The GenBank description of the gene: NM_113182 Arabidopsis thaliana
heat shock transcription factor family (At3g22830) mRNA, complete cds
gi|18403537|ref|NM_113182.1|[18403537]

The promoter sequence:
5'ataaaaattcacatttgcaaattttattcagtcggaatatatatttgaaacaagttttgaaatccattg
gacgattaaaattcattgttgagaggataaatatggatttgttcatctgaaccatgtcgttgattagtgat
tgactaccatgaaaaatatgttatgaaaagtataacaactttgataaatcacatttattaacaataaatc
aagacaaaatatgtcaacaataatagtagtagaagatattaattcaaattcatccgtaacaacaaaaaatc
ataccacaattaagtgtacagaaaaaccttttggatatatttattgtcgcttttcaatgattttcgtgaaa
aggatatatttgtgtaaaataagaaggatcttgacgggtgtaaaaacatgcacaattcttaatttagacca
atcagaagacaacacgaacacttctttattataagctattaaacaaaatcttgcctattttgcttagaata
atatgaagagtgactcatcagggagtggaaaatatctcaggatttgcttttagctctaacatgtcaaacta
tctagatgccaacaacacaaagtgcaaattcttttaatatgaaaacaacaataatatttctaatagaaaat TABLE 1-continued Promoter Sequences and Related Information
Promoter YP0384 taaaaagggaaataaaatattttttaaaatatacaaaagaagaaggaatccatcatcaaagttttataaa
attgtaatataatacaaacttgtttgcttccttgtctctccctctgtctctctcatctctcctatcttctc
catatatacttcatcttcacacccaaaactccacacaaaatatctctccctctatctgcaaattttccaaa
gttgcatcctttcaatttccactcctctctaaTATAattcacattttcccactattgctgattcatttttt
tttgtgaattatttcaaacccacataaaa 3'-TG

The promoter was cloned from the organism: *Arabidopsis thaliana*, Columbia ecotype

| Alternative nucleotides: | | |
|---|---|---|
| Predicted Position (bp) | Mismatch | Predicted/Experimental |
| 18 | SNP | c/- |

The promoter was cloned in the vector: pNewbin4-HAP1-GFP

When cloned into the vector the promoter was operably linked to a marker, which was the type: GFP-ER Promoter-marker vector was tested in: *Arabidopsis thaliana*, WS ecotype Generation screened: XT1 Mature XT2 Seedling T2 Mature T3 Seedling The spatial expression of the promoter-marker vector was found observed in and would be useful in expression in any or all of the following:
Primary Root H epidermis H trichoblast H atrichoblast Observed expression pattern of the promoter-marker vector was in:
T1 mature: No expression.
T2 seedling: High expression throughout root epidermal cells.

Misc. promoter information: Bidirectionality: Pass Exons: Pass Repeats: No

Optional Promoter Fragments: 5' UTR region at base pairs 839-999.

The Ceres cDNA ID of the endogenous coding sequence to the promoter:
12730108 cDNA nucleotide sequence:
ACAAAATATCTCTCCCTCTATCTGCAAATTTTCCAAAGTTGCATCCTTTCAATTTCCACTCCTCT
CTAATATAATTCACATTTTCCCACTATTGCTGATTCATTTTTTTTGTGAATTATTTCAAACCCA
CATAAAAAAATCTTTGTTTAAATTTAAAACCATGGATCCTTCATTTAGGTTCATTAAAGAGGA
GTTTCCTGCTGGATTCAGTGATTCTCCATCACCACCATCTTCTTCTTCATACCTTTATTCATCTT
CCATGGCTGAAGCAGCCATAAATGATCCAACAACATTGAGCTATCCACAACCATTAGAAGGTC
TCCATGAATCAGGGCCACCTCCATTTTTGACAAAGACATATGACTTGGTGGAAGATTCAAGAA
CCAATCATGTCGTGTCTTGGAGCAAATCCAATAACAGCTTCATTGTCTGGGATCCACAGGCCT
TTTCTGTAACTCTCCTTCCCAGATTCTTCAAGCACAATAACTTCTCCAGTTTTGTCCGCCAGCTC
AACACATATGGTTTCAGAAAGGTGAATCCGGATCGGTGGGAGTTTGCAAACGAAGGGTTTCTT
AGAGGGCAAAGCATCTCCTCAAGAACATAAGGAGAAGAAAAACAAGTAATAATAGTAATCA
AATGCAACAACCTCAAAGTTCTGAACAACAATCTCTAGACAATTTTTGCATAGAAGTGGGTAG
GTACGGTCTAGATGGAGAGATGGACAGCCTAAGGCGAGACAAGCAAGTGTTGATGATGGAGC
TAGTGAGACTAAGACAGCAACAACAAAGCACCAAAATGTATCTCACATTGATTGAAGAGAAG
CTCAAGAAGACCGAGTCAAAACAAAAACAAATGATGAGCTTCCTTGCCCGCGCAATGCAGAA
TCCAGATTTTATTCAGCAGCTAGTAGAGCAGAAGGAAAAGAGGAAAGAGATCGAAGAGGCGA
TCAGCAAGAAGAGACAAAGACCGATCGATCAAGGAAAAAGAAATGTGGAAGATTATGGTGAT
GAAAGTGGTTATGGGAATGATGTTGCAGCCTCATCCTCAGCATTGATTGGTATGAGTCAGGAA
TATACATATGGAAACATGTCTGAATTCGAGATGTCGGAGTTGGACAAACTTGCTATGCACATT
CAAGGACTTGGAGATAATTCCAGTGCTAGGGAAGAAGTCTTGAATGTGGAAAAAGGAAATGA
TGAGGAAGAAGTAGAAGATCAACAACAAGGGTACCATAAGGAGAACAATGAGATTTATGGTG
AAGGTTTTTGGGAAGATTTGTTAAATGAAGGTCAAAATTTTGATTTGAAGGAGATCAAGAAA
ATGTTGATGTGTTAATTCAGCAACTTGGTTATTTGGGTTCTAGTTCACACACTAATTAAGAAGA
AATTGAAATGATGACTACTTTAAGCATTTGAATCAACTTGTTTCCTATTAGTAATTTGGCTTTG
TTTCAATCAAGTGAGTCGTGGACTAACTTATTGAATTTGGGGGTTAAATCCGTTTCTTATTTTT
GGAAATAAAATTGCTTTTTGTTT Coding sequence:
MDPSFRFIKEEFPAGFSDSPSPPSSSSYLYSSSMAEAAINDPTTLSYPQPLEGLHESGPPPFLTKTYDL
VEDSRTNHVVSWSKSNNSFIVWDPQAFSVTLLPRFFKHNNFSSFVRQLNTYGFRKVNPDRWEFAN
EGFLRGQKHLLKNIRRRKTSNNSNQMQQPQSSEQQSLDNFCIEVGRYGLDGEMDSLRRDKQVLM
MELVRLRQQQQSTKMYLTLIEEKLKKTESKQKQMMSFLARAMQNPDFIQQLVEQKEKRKEIEEAI
SKKRQRPIDQGKRNVEDYGDESGYGNDVAASSSALIGMSQEYTYGNMSEFEMSELDKLAMHIQG
LGDNSSAREEVLNVEKGNDEEEVEDQQQGYHKENNEIYGEGFWEDLLNEGQNFDFEGDQENVDV
LIQQLGYLGSSSHTN*

TABLE 1-continued

Promoter Sequences and Related Information
Promoter YP0384

Microarray data shows that the coding sequence was expressed in the
following experiments, which shows that the promoter would be useful
to modulate expression in situations similar to the following:

| CDNA_ID | SHORT_NAME | EXPT_REP_ID | IS_UP |
|---|---|---|---|
| 12730108 | At_Drought | 20000267 | + |
| 12730108 | At_100 mM_NaCl | 20000268 | + |
| 12730108 | At_Drought | 20000288 | + |
| 12730108 | At_Drought | 20000436 | + |
| 12730108 | At_Drought | 20000437 | + |
| 12730108 | At_Guard_Cells | 20000495 | - |
| 12730108 | At_Herbicide_Mutants | 20000639 | - |
| 12730108 | At_Herbicide_Mutants | 20000641 | - |
| 12730108 | At_Drought_Reproduction | 20001904 | + |
| 12730108 | At_Drought_Reproduction | 20001905 | + |
| 12730108 | At_Drought_Reproduction | 20001911 | + |
| 12730108 | At_Drought-Air-Dry | 20002254 | + |

The parameters for the microarray experiments listed above by
Expt_Rep_ID and Short_Name are as follow below:

| CDNA_ID | SHORT_NAME | EXPT_REP_ID | PARAM_NAME | VALUE |
|---|---|---|---|---|
| 12730108 | At_Drought | 20000267 | Timepoint (hr) | 6 |
| 12730108 | At_Drought | 20000267 | Age (day) | 7 |
| 12730108 | At_Drought | 20000267 | Organism | A. thaliana |
| 12730108 | At_Drought | 20000267 | Treatment | Drought vs. No Drought |
| 12730108 | At_Drought | 20000267 | Tissue | Whole Plant |
| 12730108 | At_Drought | 20000267 | Plant Line | WS |
| 12730108 | At_100 mM_NaCl | 20000268 | Timepoint (hr) | 6 |
| 12730108 | At_100 mM_NaCl | 20000268 | Age (day) | 14 |
| 12730108 | At_100 mM_NaCl | 20000268 | Treatment | 100 mM NaCl vs. No Treatment |
| 12730108 | At_100 mM_NaCl | 20000268 | Organism | A. thaliana |
| 12730108 | At_100 mM_NaCl | 20000268 | Tissue | Whole Plant |
| 12730108 | At_100 mM_NaCl | 20000268 | Plant Line | WS |
| 12730108 | At_Drought | 20000288 | Timepoint (hr) | 1 |
| 12730108 | At_Drought | 20000288 | Age (day) | 7 |
| 12730108 | At_Drought | 20000288 | Organism | A. thaliana |
| 12730108 | At_Drought | 20000288 | Treatment | Drought vs. No Drought |
| 12730108 | At_Drought | 20000288 | Tissue | Whole Plant |
| 12730108 | At_Drought | 20000288 | Plant Line | WS |
| 12730108 | At_Drought | 20000436 | Age (day) | 7 |
| 12730108 | At_Drought | 20000436 | Timepoint (hr) | 12 |
| 12730108 | At_Drought | 20000436 | Organism | A. thaliana |

TABLE 1-continued

Promoter Sequences and Related Information
Promoter YP0384

| 12730108 | At_Drought | 20000436 | Treatment | Drought vs. No Drought |
|---|---|---|---|---|
| 12730108 | At_Drought | 20000436 | Tissue | Whole Plant |
| 12730108 | At_Drought | 20000436 | Plant Line | WS |
| 12730108 | At_Drought | 20000437 | Age (day) | 8 |
| 12730108 | At_Drought | 20000437 | Timepoint (hr) | 24 |
| 12730108 | At_Drought | 20000437 | Organism | *A. thaliana* |
| 12730108 | At_Drought | 20000437 | Treatment | Drought vs. No Drought |
| 12730108 | At_Drought | 20000437 | Tissue | Whole Plant |
| 12730108 | At_Drought | 20000437 | Plant Line | WS |
| 12730108 | At_Guard_Cells | 20000495 | Harvest Date | Aug. 2, 2002 |
| 12730108 | At_Guard_Cells | 20000495 | Organism | *A. thaliana* |
| 12730108 | At_Guard_Cells | 20000495 | Tissue | Guard Cells vs. Leaves |
| 12730108 | At_Herbicide_Mutants | 20000639 | Timepoint (hr) | 4 |
| 12730108 | At_Herbicide_Mutants | 20000639 | Plant Line | 05377RR/BR27173 |
| 12730108 | At_Herbicide_Mutants | 20000639 | Treatment | Roundup vs. No Treatment |
| 12730108 | At_Herbicide_Mutants | 20000639 | Tissue | Seedlings |
| 12730108 | At_Herbicide_Mutants | 20000641 | Timepoint (hr) | 4 |
| 12730108 | At_Herbicide_Mutants | 20000641 | Plant Line | 3950BR/PCJE10000 |
| 12730108 | At_Herbicide_Mutants | 20000641 | Treatment | Finale vs. No Treatment |
| 12730108 | At_Herbicide_Mutants | 20000641 | Tissue | Seedlings |
| 12730108 | At_Drought_Reproduction | 20001904 | Timepoint (day) | 7 |
| 12730108 | At_Drought_Reproduction | 20001904 | Age (day) | 37 |
| 12730108 | At_Drought_Reproduction | 20001904 | Organism | *A. thaliana* |
| 12730108 | At_Drought_Reproduction | 20001904 | Treatment | Drought vs. No Drought |
| 12730108 | At_Drought_Reproduction | 20001904 | Tissue | Rosettes |
| 12730108 | At_Drought_Reproduction | 20001904 | Plant Line | WS |
| 12730108 | At_Drought_Reproduction | 20001905 | Timepoint (day) | 10 |
| 12730108 | At_Drought_Reproduction | 20001905 | Age (day) | 40 |
| 12730108 | At_Drought_Reproduction | 20001905 | Organism | *A. thaliana* |
| 12730108 | At_Drought_Reproduction | 20001905 | Treatment | Drought vs. No Drought |
| 12730108 | At_Drought_Reproduction | 20001905 | Tissue | Rosettes |
| 12730108 | At_Drought_Reproduction | 20001905 | Plant Line | WS |
| 12730108 | At_Drought_Reproduction | 20001911 | Timepoint (day) | 10 |
| 12730108 | At_Drought_Reproduction | 20001911 | Age (day) | 40 |
| 12730108 | At_Drought_Reproduction | 20001911 | Organism | *A. thaliana* |
| 12730108 | At_Drought_Reproduction | 20001911 | Treatment | Drought vs. No Drought |
| 12730108 | At_Drought_Reproduction | 20001911 | Tissue | Flowers |
| 12730108 | At_Drought_Reproduction | 20001911 | Plant Line | WS |
| 12730108 | At_Drought-Air-Dry | 20002254 | Timepoint (hr) | 4 |

TABLE 1-continued

Promoter Sequences and Related Information
Promoter YP0384

| 12730108 | At_Drought-Air-Dry | 20002254 | Age (day) | 35 |
| --- | --- | --- | --- | --- |
| 12730108 | At_Drought-Air-Dry | 20002254 | Organism | *A. thaliana* |
| 12730108 | At_Drought-Air-Dry | 20002254 | Treatment | Drought vs. No Drought |
| 12730108 | At_Drought-Air-Dry | 20002254 | Tissue | Roots |
| 12730108 | At_Drought-Air-Dry | 20002254 | Plant Line | WS |

```
Promoter YP0015

Modulates the gene: EREBP-2

The GenBank description of the gene: NM_124093 Arabidopsis thaliana ethylene
responsive element binding factor 2 (EREBP-2) (At5g47220) mRNA, complete cds
gi|30695135|ref|NM_124093.2|[30695135]

The predicted promoter sequence:

5'ttgagccttattgttgttattgacttttagccaatagaaagagatggaaattcaataattatccacaaaattccaa
atcattggtgtacaaaaagatctaaggctgttatattttcaaaaaagaaagaaaagaaatgcaacaaatatggattaa
actgtggtttgtaaattgagctttgcatgaaaactttatcactatgatttcactactccatatttattgactaaagtg
gcactaatgaatttcttaatcatgaaatcttgtatcaaaaagtactaaaataaacatgacattggcaattaggaaaat
tctaaattagaaattagtaaaaatgaaaggtgaaagggaaagatgatgatatgaattggttggtgaccaggagaaatg
tatcccgattttttgcagacactttcagtgtccccattcatataattatggcccacctcgttaagattttttcattcacc
accataacaagatctaagcttagatttcatgtaattaaacatataatatacttgccaatactatctaataaagtatac
ttaagcaaaaattattactctagtgtaaggcgatgaaatataagtttagttgaaaatttatgtcgatataacaaagta
taatgaattaagaccttggttttcgattaacaaactaattaaacactagttttgcctaataaaaccgggaatcgtatt
caaaaccgaacgacaaaacaagggacaagttgagagacaaaaccaaatcagcatctttcttccagaaatgtcatgacc
acatgacgtcatcttgacccttcttcattgtgatatctgtggataaagcgcacgtgtttaattcacgaaccttcgtag
taacgaaaaatccacaactttcatatttttaattacccactaaactaaaacaaatttggaaaaacatgaaaaacttt
ttctttttttccaggttcgtgaacctcgtaccctctaTATAaacctcttaaccaccttccacata3'-aATG The promoter was cloned from the organism:

Arabidopsis thaliana, WS ecotype

The experimental promoter sequence:

ttgagccttattgttgttattgacttttagccaatagaaagagatggaaattcaataattatccacaaaattccaat
cattggtgtacaaaaagatctaaggctgttatattttccaaaaaagaaagaaaagaaatgcaacaaatatggattaaac
tgtggtttgtaaattgagctttgcatgaaaactttatcactatgatttcactactccatatttattgactaaagtggc
actaatgaatttcttaatcatgaaatcttgtatcaaaaagtactaaaataaacatgacattggcaattaggaaaattc
taaattagaaattagtaaaaatgaaaggtgaaagggaaagatgatgatatgaattggttggtgaccaggagaaatgta
tcccgattttttgcagacactttcagtgtccccattcatataattatggcccacctcgttaagattttttcattcaccac
cataacaagatctaagcttagatttcatgtaattaaacatataatatacttgccaatactatctaataaagtatactt
aagcaaaaattattactctagtgtaaggcgatgaaatataagtttagttgaaaatttatgtcgatataacaaagtata
atgaattaagaccttggttttcgattaacaaactaattaaacactagttttgcctaataaaaccgggaatcgtattca
aaaccgaacgacaaaacaagggacaagttgagagacaaaaccaaatcagcatctttcttccagaaatgtcatgaccac
atgacgtcatcttgacccttcttcattgtgatatctgtggataaagcgcacgtgtttaattcacgaaccttcgtagta
acgaaaaatccacaactttcatatttttaattacccactaaactaaaacaaatttggaaaaacatgaaaaactttttt
cttttttccaggttcgtgaacctcgtaccctctatataaacctctta The promoter was cloned in the vector: pNewbin4-HAP1-GFP When cloned into the vector the promoter was operably linked to a marker which was the type: GFP-ER
```

-continued

| |
|---|
| Promoter-marker was tested in: |
| *Arabidopsis thaliana*, WS ecotype |

| |
|---|
| Generation Screened: (X)T1 Mature ( )T2 Seedling ( )T2 Mature ( )T3 Seedling |

The spatial expression of the promoter-marker vector was found, observed in and would be useful in expression in any or all of the following:

| | |
|---|---|
| Flower | H carpel H epidermis L pedicel |
| | L sepal H silique L stomata |
| Leaf | H epidermis H mesophyll L vascular |
| Primary Root | L root hairs |
| Silique | L abscission zone H carpel H epidermis |
| | L stomata |

Observed expression pattern of the promoter-marker vector was in:

T1 mature: GFP expression at the base of sepals at abscission zone of developing and mature flowers High expression specific to carpels of developing and mature siliques T2 seedling: Weak root hair expression at hypocotyl transition zone observed in 1 in 6 seedlings and in only1 of 2 events screened Likely to be an artifact Misc. promoter information:

Bidirectionality:PASS Exons:PASS Repeats:PASS

An overlap in an exon with the endogenous coding sequence to the promoter occurs at base pairs

N/A

The Ceres cDNA ID of the endogenous coding sequence to the promoter: 13612380 cDNA nucleotide sequence:

AAAAAAGTTCAGATATTTGATAAATCAATCAACAAAACAAAAAAAACTCTATAGTTAGTTTCTCTGAAAATGTACGGA
CAGTGCAATATAGAATCCGACTACGCTTTGTTGGAGTCGATAACACGTCACTTGCTAGGAGGAGGAGGAGAGAACGAG
CTGCGACTCAATGAGTCAACACCGAGTTCGTGTTTCACAGAGAGTTGGGGAGGTTTGCCATTGAAAGAGAATGATTCA
GAGGACATGTTGGTGTACGGACTCCTCAAAGATGCCTTCCATTTTGACACGTCATCATCGGACTTGAGCTGTCTTTTT
GATTTTCCGGCGGTTAAAGTCGAGCCAACTGAGAACTTTACGGCGATGGAGGAGAAACCAAAGAAAGCGATACCGGTT
ACGGAGACGGCAGTGAAGGCGAAGCATTACAGAGGAGTGAGGCAGAGACCGTGGGGGAAATTCGCGGCGGAGATACGT
GATCCGGCGAAGAATGGAGCTAGGGTTTGGTTAGGGACGTTTGAGACGGCGGAAGATGCGGCTTTAGCTTACGATATA
GCTGCTTTTAGGATGCGTGGTTCCCGCGCTTTATTGAATTTTCCGTTGAGGGTTAATTCCGGTGAACCTGACCCGGTT
CGGATCACGTCTAAGAGATCTTCTTCGTCGTCGTCGTCGTCCTCTTCTACGTCGTCGTCTGAAAACGGGAAGTTG
AAACGAAGGAGAAAAGCAGAGAATCTGACGTCGGAGGTGGTGCAGGTGAAGTGTGAGGTTGGTGATGAGACACGTGTT
GATGAGTTATTGGTTTCATAAGTTTGATCTTGTGTGTTTTGTAGTTGAATAGTTTTGCTATAAATGTTGAGGCACCAA
GTAAAAGTGTTCCCGTGATGTAAATTAGTTACTAAACAGAGCCATATATCTTCAATCCATAAACAAAATAGACACTTT
AATAAAGCCGTGAGTGTTAATTTTTC

Coding Sequence:

MYGQCNIESDYALLESITRHLLGGGGENELRLNESTPSSCFTESWGGLPLKENDSEDMLVYGLLKDAFHFDTSSSDLS
CLFDFPAVKVEPTENFTAMEEKPKKAIPVTETAVKAKHYRGVRQRPWGKFAAEIRDPAKNGARVWLGTFETAEDAALA
YDIAAFRMRGSRALLNFPLRVNSGEPDPVRITSKRSSSSSSSSSSSSTSSSENGKLKRRRKAENLTSEVVQVKCEVGDE
TRVDELLVS*

-continued

```
Microarray data shows that the coding sequence was expressed in the following
experiments, which shows that the promoter would be useful to modulate
expression in situations similar to the following:

CDNA_ID: 13612380
-----------------

SHORT_NAME                   EXPT_REP_ID         IS_UP
-------------------------------------------------------------------------------
At_0.001%_MeJA                  108568             +

At_100 uM_ABA_Mutants         20000069             +

At_100 uM_ABA_Mutants         20000072             +

At_100 uM_ABA_Mutants         20000086             +

At_100 uM_ABA_Mutants         20000088             +

At_100 uM_ABA_Mutants         20000573             -

At_100 uM_ABA_Mutants         20000574             -

At_100 uM_ABA                 20000166             -

At_100 uM_ABA                 20000169             -

At_100 uM_ABA                   108560             -

At_100 uM_ABA                   108561             -

At_100 uM_ABA                   108605             -

At_100 uM_ABA                   108606             -

At_10 percent_PEG             20000460             +

At_15 mM_NH4NO3_L-to-H          108588             +

At_15 mM_NH4NO3_L-to-H          108591             -

At_18 percent_PEG_Hydroponic  20001955             -

At_18 percent_PEG_Hydroponic  20001956             -

At_1 uM_BR-BRZ                20000441             +

At_1 uM_BR-BRZ                20000443             +

At_20 uM_KNO3_H-to-L            108454             +

At_20 uM_KNO3_H-to-L            108455             +

At_2 mM_SA_CS3726-Columbia    20000090             +

At_2 mM_SA                      108667             +

At_2 mM_SA                    20000181             +

At_2 mM_SA                      108586             -

At_2 mM_SA                      108587             -

At_42 deg_Heat                20000111             -

At_42 deg_Heat                20000113             -

At_42 deg_Heat                20000144             -

At_42 deg_Heat                20000171             -

At_42 deg_Heat                20000173             -
```

| | | |
|---|---|---|
| At_42 deg_Heat | 20000458 | - |
| At_42 deg_Heat | 108577 | - |
| At_4 deg_Cold | 20000213 | + |
| At_4 deg_Cold | 108579 | + |
| At_5 mM_H2O2 | 20000270 | - |
| At_5 mM_NaNP | 108584 | + |
| At_5 mM_NaNP | 108585 | + |
| At_8 deg_Cold | 20002107 | + |
| At_CS237-vs-Columbia | 20000046 | - |
| At_CS3071_vs_Columbia | 20000066 | - |
| At_CS6879_Shoots-Roots | 20000452 | + |
| At_Circadian-Rhythm-&-Shade | 20002471 | + |
| At_Diversity_Expt | 108457 | + |
| At_Diversity_Expt | 108458 | + |
| At_Drought_Reproduction | 20001904 | - |
| At_Drought_Reproduction | 20001905 | - |
| At_Drought_Soil_Dry | 20001554 | - |
| At_Drought_Soil_Dry | 20001555 | - |
| At_Drought_Soil_Dry | 20001556 | - |
| At_Drought_Soil_Dry | 20001558 | - |
| At_Drought | 20000436 | - |
| At_Drought | 20000437 | - |
| At_Drought | 108573 | - |
| At_Far-red-induction | 20001248 | + |
| At_Far-red-induction | 20001451 | - |
| At_Germinating_Seeds | 20000179 | - |
| At_Germinating_Seeds | 20000180 | - |
| At_Germinating_Seeds | 108464 | + |
| At_Guard_Cells | 20000495 | - |
| At_Herbicide_Mutants | 20000639 | - |
| At_Herbicide_Mutants | 20000640 | - |
| At_Interploidy_Crosses | 20001853 | - |
| At_Ler-pi_Ovule | 108595 | + |
| At_Ler-rhl_Root | 108594 | + |
| At_Line_Comparisons_NA | 20001097 | - |
| At_Line_Comparisons_NA | 20001163 | + |
| At_Line_Comparisons | 20001184 | - |
| At_Line_Comparisons | 20001300 | - |
| At_Line_Comparisons | 20001347 | + |
| At_Line_Comparisons | 20002009 | + |

```
|At_Open_Flower           20000264               -
|
|At_Open_Flower           20000265               -
|
|At_Open_Flower           20000286               -
|
|At_Petals                20000794               -
|
|At_Pollen                20000326               -
|
|At_Root_Tips              108434                -
|
|At_Roots                 20000185               -
|
|At_Roots                 20000439               -
|
|At_Shoot_Apices           108480                +
|
|At_Shoot_Apices           108481                +
|
|At_Shoots                20000184               -
|
|At_Shoots                20000438               -
|
|At_Siliques              20000234               -
|
|At_Siliques              20000236               -
|
|At_Wounding               108574                +
|
|At_Wounding               108575                -
|
|At_stm_Mutants            108435                +
|
|
|_____|
|The parameters for the microarray experiments listed above by Expt_Rep_ID and |
|Short_name are as follow below:
|
|
|CDNA_ID: 13612380
|
|-----------------
|
|
|
|
|SHORT_NAME: At_0.001%_MeJA
|
|-----------------
|
|EXPT_REP_ID             PARAM_NAME             VALUE
|
|----------------------------------------------------------------------|
|  108568                Timepoint (hr)         1
|
|  108568                Tissue                 Aerial
|
|  108568                Treatment              0.001% MeJA vs. No Treatment
|
|
|
|SHORT_NAME: At_100 uM_ABA_Mutants
|
|-----------------
|
|EXPT_REP_ID             PARAM_NAME             VALUE
|
|----------------------------------------------------------------------|
|20000069                Plant Line             CS23
|
|20000069                Timepoint (hr)         6
|
|20000069                Tissue                 Aerial
|
|20000069                Treatment              100 uM ABA vs. No Treatment
|
|20000072                Plant Line             CS8105
```

-continued

```
|20000072                    Timepoint (hr)         6
|
|20000072                    Tissue                 Aerial
|
|20000072                    Treatment              100 uM ABA vs. No Treatment
|
|20000086                    Plant Line             CS22
|
|20000086                    Timepoint (hr)         6
|
|20000086                    Tissue                 Aerial
|
|20000086                    Treatment              100 uM ABA vs. No Treatment
|
|20000088                    Plant Line             Landsberg
|
|20000088                    Timepoint (hr)         6
|
|20000088                    Tissue                 Aerial
|
|20000088                    Treatment              100 uM ABA vs. No Treatment
|
|20000573                    Organism               A. thaliana
|
|20000573                    Plant Line             CS22 vs. Ler wt
|
|20000573                    Timepoint (hr)         N/A
|
|20000573                    Tissue                 Whole Plant
|
|20000573                    Treatment              None
|
|20000574                    Organism               A. thaliana
|
|20000574                    Plant Line             CS23 vs. Ler wt
|
|20000574                    Timepoint (hr)         N/A
|
|20000574                    Tissue                 Whole Plant
|
|20000574                    Treatment              None
|
|
|SHORT NAME: At_100 uM_ABA
|----------------
|
|EXPT_REP_ID                 PARAM_NAME             VALUE
|------------------------------------------------------------------------|
|20000166                    Age (day)              14
|
|20000166                    Organism               A. thaliana
|
|20000166                    Plant Line             WS
|
|20000166                    Timepoint (hr)         1
|
|20000166                    Tissue                 Aerial
|
|20000166                    Treatment              100 uM ABA vs. No Treatment
|
|20000169                    Age (day)              14
|
|20000169                    Organism               A. thaliana
|
|20000169                    Plant Line             WS
|
|20000169                    Timepoint (hr)         6
|
|20000169                    Tissue                 Aerial
|
|20000169                    Treatment              100 uM ABA vs. No Treatment
|
|  108560                    Timepoint (hr)         1
|
|  108560                    Tissue                 Aerial
|
|  108560                    Treatment              100 uM ABA vs. No Treatment
```

-continued

```
| 108561                         Timepoint (hr)        6

| 108561                         Tissue                Aerial

| 108561                         Treatment             100 uM ABA vs. No Treatment

| 108605                         Timepoint (hr)        6

| 108605                         Tissue                Aerial

| 108605                         Treatment             100 uM ABA vs. No Treatment

| 108606                         Timepoint (hr)        2

| 108606                         Tissue                Aerial

| 108606                         Treatment             100 uM ABA vs. No Treatment

|SHORT_NAME: At_10 percent_PEG
|----------------
|EXPT_REP_ID                    PARAM_NAME             VALUE
|------------------------------------------------------------------------------|
|20000460                       Age (day)              12

|20000460                       Organism               A. thaliana

|20000460                       Plant Line             WS

|20000460                       Timepoint (day)        12

|20000460                       Tissue                 Whole Plant

|20000460                       Treatment              10 percent PEG vs. No Treatment

|SHORT_NAME: At_15 mM_NH4NO3_L-to-H
|----------------
|EXPT_REP_ID                    PARAM_NAME             VALUE
|------------------------------------------------------------------------------|
|  108588                       Timepoint (hr)         2

|  108588                       Tissue                 Aerial

|  108588                       Treatment              15 mM NH4NO3 vs. 30 mM Mannitol

|  108591                       Timepoint (hr)         12

|  108591                       Tissue                 Aerial

|  108591                       Treatment              15 mM NH4NO3 vs. 30 mM Mannitol

|SHORT_NAME: At_18 percent_PEG_Hydroponic
|----------------
|EXPT_REP_ID                    PARAM_NAME             VALUE
|------------------------------------------------------------------------------|
|20001955                       Age (day)              35

|20001955                       Organism               A. thaliana

|20001955                       Plant Line             WS

|20001955                       Timepoint (hr)         1

|20001955                       Tissue                 Shoots

|20001955                       Treatment              18 percent PEG vs. No Treatment
```

-continued

```
|20001956                 Age (day)            35
|
|20001956                 Organism             A. thaliana
|
|20001956                 Plant Line           WS
|
|20001956                 Timepoint (hr)       4
|
|20001956                 Tissue               Shoots
|
|20001956                 Treatment            18 percent PEG vs. No Treatment
|
|
|SHORT_NAME: At_1 uM_BR-BRZ
|
|----------------
|
|EXPT_REP_ID              PARAM_NAME           VALUE
|
|--------------------------------------------------------------------------|
|20000441                 Tissue               Shoot Apices
|
|20000441                 Treatment            1 uM BR vs. No Treatment
|
|20000443                 Tissue               Shoot Apices
|
|20000443                 Treatment            1 uM BRZ vs. No Treatment
|
|
|SHORT_NAME: At_20 uM_KNO3_H-to-L
|
|----------------
|
|EXPT_REP_ID              PARAM_NAME           VALUE
|
|--------------------------------------------------------------------------|
|  108454                 Timepoint (hr)       0.16
|
|  108454                 Treatment            20 uM KNO3 vs. 50 mM KNO3
|
|  108455                 Timepoint (hr)       1
|
|  108455                 Treatment            20 uM KNO3 vs. 50 mM KNO3
|
|
|SHORT_NAME: At_2 mM_SA_CS3726-Columbia
|
|----------------
|
|EXPT_REP_ID              PARAM_NAME           VALUE
|
|--------------------------------------------------------------------------|
|20000090                 Plant Line           Columbia
|
|20000090                 Timepoint (hr)       6
|
|20000090                 Tissue               Aerial
|
|20000090                 Treatment            2 mM SA vs. No Treatment
|
|
|SHORT_NAME: At_2 mM_SA
|
|----------------
|
|EXPT_REP_ID              PARAM_NAME           VALUE
|
|--------------------------------------------------------------------------|
|  108667                 Plant Line           WS
|
|  108667                 Timepoint (hr)       1
|
|  108667                 Treatment            2 mM SA vs. No Treatment
|
|20000181                 Age (day)            14
|
```

```
                         -continued
|20000181                 Organism               A. thaliana
|
|20000181                 Plant Line              WS
|
|20000181                 Timepoint (hr)          1
|
|20000181                 Tissue                 Aerial
|
|20000181                 Treatment              2 mM SA vs. No Treatment
|
|  108586                 Timepoint (hr)          1
|
|  108586                 Tissue                 Aerial
|
|  108586                 Treatment              2 mM SA vs. No Treatment
|
|  108587                 Timepoint (hr)          6
|
|  108587                 Tissue                 Aerial
|
|  108587                 Treatment              2 mM SA vs. No Treatment
|
|
|SHORT_NAME: At_42 deg_Heat
|
|----------------
|
|EXPT_REP_ID              PARAM_NAME             VALUE
|
|-------------------------------------------------------------------------|
|20000111                 Age (day)               14
|
|20000111                 Organism               A. thaliana
|
|20000111                 Plant Line              WS
|
|20000111                 Temperature (deg C)    42 vs. 22
|
|20000111                 Timepoint (hr)          6
|
|20000111                 Tissue                 Aerial
|
|20000113                 Age (day)               14
|
|20000113                 Organism               A. thaliana
|
|20000113                 Plant Line              WS
|
|20000113                 Temperature (deg C)    42 vs. 22
|
|20000113                 Timepoint (hr)          8
|
|20000113                 Tissue                 Aerial
|
|20000144                 Age (day)               14
|
|20000144                 Organism               A. thaliana
|
|20000144                 Plant Line              WS
|
|20000144                 Temperature (deg C)    42 vs. 22
|
|20000144                 Timepoint (hr)          1
|
|20000144                 Tissue                 Aerial
|
|20000171                 Age (day)               14
|
|20000171                 Organism               A. thaliana
|
|20000171                 Plant Line              WS
|
|20000171                 Temperature (deg C)    42 vs. 22
|
|20000171                 Timepoint (hr)          1
|
|20000171                 Tissue                 Aerial
|
|20000173                 Age (day)               14
|
```

-continued

```
|20000173                      Organism             A. thaliana
|
|20000173                      Plant Line           WS
|
|20000173                      Temperature (deg C)  42 vs. 22
|
|20000173                      Timepoint (hr)       6
|
|20000173                      Tissue               Aerial
|
|20000458                      Age (day)            14
|
|20000458                      Organism             A. thaliana
|
|20000458                      Plant Line           WS
|
|20000458                      Temperature (deg C)  42 vs. 22
|
|20000458                      Timepoint (hr)       8
|
|20000458                      Tissue               Aerial
|
|  108577                      Age (day)            14
|
|  108577                      Organism             A. thaliana
|
|  108577                      Plant Line           WS
|
|  108577                      Temperature (deg C)  42 vs. 22
|
|  108577                      Timepoint (hr)       6
|
|  108577                      Tissue               Aerial
|
|
|SHORT_NAME: At_4 deg_Cold
|
|-----------------
|
|EXPT_REP_ID                   PARAM_NAME           VALUE
|
|------------------------------------------------------------------------------|
|20000213                      Timepoint (hr)       2
|
|  108579                      Age (day)            14
|
|  108579                      Organism             A. thaliana
|
|  108579                      Plant Line           WS
|
|  108579                      Temperature (deg C)  4 vs. 22
|
|  108579                      Timepoint (hr)       6
|
|  108579                      Tissue               Aerial
|
|
|SHORT_NAME: At_5 mM_H2O2
|
|-----------------
|
|EXPT_REP_ID                   PARAM_NAME           VALUE
|
|------------------------------------------------------------------------------|
|20000270                      Timepoint (hr)       6
|
|20000270                      Tissue               Aerial
|
|20000270                      Treatment            5 mM H2O2 vs. No Treatment
|
|
|SHORT_NAME: At_5 mM_NaNP
|
|-----------------
|
|EXPT_REP_ID                   PARAM_NAME           VALUE
|
|------------------------------------------------------------------------------|
```

```
                            -continued
| 108584                   Timepoint (hr)         1
|
| 108584                   Tissue                 Aerial
|
| 108584                   Treatment              5 mM sodium nitroprusside
|                                                 vs. No Treatment
|
| 108585                   Timepoint (hr)         6
|
| 108585                   Tissue                 Aerial
|
| 108585                   Treatment              5 mM sodium nitroprusside
|                                                 vs. No Treatment
|
|
|SHORT_NAME: At_8 deg_Cold
|
|-----------------
|
|EXPT_REP_ID              PARAM_NAME             VALUE
|
|-------------------------------------------------------------------------|
|20002107                 Age (day)              11
|
|20002107                 Organism               A. thaliana
|
|20002107                 Plant Line             WS
|
|20002107                 Temperature (deg C)    8 vs. 22
|
|20002107                 Timepoint (hr)         96
|
|20002107                 Tissue                 Whole Plant
|
|
|SHORT_NAME: At_CS237-vs-Columbia
|
|-----------------
|
|EXPT_REP_ID              PARAM_NAME             VALUE
|
|-------------------------------------------------------------------------|
|20000046                 Plant Line             CS237 vs. Columbia
|
|20000046                 Tissue                 Aerial
|
|
|SHORT_NAME: At_CS3071_vs_Columbia
|
|-----------------
|
|EXPT_REP_ID              PARAM_NAME             VALUE
|
|-------------------------------------------------------------------------|
|20000066                 Plant Line             CS3071 vs. Columbia
|
|20000066                 Tissue                 Aerial
|
|
|SHORT_NAME: At_CS6879_Shoots-Roots
|
|-----------------
|
|EXPT_REP_ID              PARAM_NAME             VALUE
|
|-------------------------------------------------------------------------|
|20000452                 Age (day)              14
|
|20000452                 Organism               A. thaliana
|
```

-continued

```
|20000452                      Plant Line              CS6879 vs. WS
|
|20000452                      Tissue                  Shoots
|
|
|
|SHORT_NAME: At_Circadian-Rhythm-&-Shade
|
|----------------
|
|EXPT_REP_ID                   PARAM_NAME              VALUE
|
|-------------------------------------------------------------------------|
|20002471                      Age (day)               7
|
|20002471                      Organism                A. thaliana
|
|20002471                      Plant Line              Columbia
|
|20002471                      Timepoint (hr)          16
|
|20002471                      Tissue                  Whole Plant
|
|20002471                      Treatment               Far-red vs. White
|
|
|
|SHORT_NAME: At_Diversity_Expt
|
|----------------
|
|EXPT_REP_ID                   PARAM_NAME              VALUE
|
|-------------------------------------------------------------------------|
|  108457                      Plant Line              Canola vs. WS
|
|  108457                      Tissue                  Hypocotyl
|
|  108458                      Plant Line              Holbolliie vs. WS
|
|  108458                      Tissue                  Hypocotyl
|
|
|
|SHORT_NAME: At_Drought_Reproduction
|
|----------------
|
|EXPT_REP_ID                   PARAM_NAME              VALUE
|
|-------------------------------------------------------------------------|
|20001904                      Age (day)               37
|
|20001904                      Organism                A. thaliana
|
|20001904                      Plant Line              WS
|
|20001904                      Timepoint (day)         7
|
|20001904                      Tissue                  Rosettes
|
|20001904                      Treatment               Drought vs. No Drought
|
|20001905                      Age (day)               40
|
|20001905                      Organism                A. thaliana
|
|20001905                      Plant Line              WS
|
|20001905                      Timepoint (day)         10
|
```

-continued

```
|20001905                       Tissue                  Rosettes
|
|20001905                       Treatment               Drought vs. No Drought
|
|
|SHORT_NAME: At_Drought_Soil_Dry
|
|-----------------
|
|EXPT_REP_ID                    PARAM_NAME              VALUE
|
|------------------------------------------------------------------------|
|20001554                       Age (day)               21
|
|20001554                       Organism                A. thaliana
|
|20001554                       Plant Line              WS
|
|20001554                       Post Timepoint (hr)     None
|
|20001554                       Post-Treatment          None
|
|20001554                       Timepoint (day)         7
|
|20001554                       Treatment               Drought vs. No Drought
|
|20001555                       Age (day)               24
|
|20001555                       Organism                A. thaliana
|
|20001555                       Plant Line              WS
|
|20001555                       Post Timepoint (hr)     None
|
|20001555                       Post-Treatment          None
|
|20001555                       Timepoint (day)         10
|
|20001555                       Treatment               Drought vs. No Drought
|
|20001556                       Age (day)               26
|
|20001556                       Organism                A. thaliana
|
|20001556                       Plant Line              WS
|
|20001556                       Post Timepoint (hr)     None
|
|20001556                       Post-Treatment          None
|
|20001556                       Timepoint (day)         12
|
|20001556                       Treatment               Drought vs. No Drought
|
|20001558                       Age (day)               27
|
|20001558                       Organism                A. thaliana
|
|20001558                       Plant Line              WS
|
|20001558                       Post Timepoint (hr)     6
|
|20001558                       Post-Treatment          Re-Water vs. No Drought
|
|20001558                       Timepoint (day)         13
|
|20001558                       Treatment               Drought vs. No Drought
|
|
|SHORT_NAME: At_Drought
|
|-----------------
|
|EXPT_REP_ID                    PARAM_NAME              VALUE
|
|------------------------------------------------------------------------|
|20000436                       Age (day)               7
|
|20000436                       Organism                A. thaliana
```

```
|20000436                    Plant Line            WS
|
|20000436                    Timepoint (hr)        12
|
|20000436                    Tissue                Whole Plant
|
|20000436                    Treatment             Drought vs. No Drought
|
|20000437                    Age (day)             8
|
|20000437                    Organism              A. thaliana
|
|20000437                    Plant Line            WS
|
|20000437                    Timepoint (hr)        24
|
|20000437                    Tissue                Whole Plant
|
|20000437                    Treatment             Drought vs. No Drought
|
|  108573                    Timepoint (hr)        6
|
|  108573                    Tissue                Aerial
|
|  108573                    Treatment             Drought vs. No Drought
|
|
|SHORT_NAME: At_Far-red-induction
|
|-----------------
|
|EXPT_REP_ID                 PARAM_NAME            VALUE
|
|------------------------------------------------------------------------------|
|20001248                    Age (day)             7
|
|20001248                    Light                 Far-red vs. White
|
|20001248                    Organism              A. thaliana
|
|20001248                    Plant Line            Columbia
|
|20001248                    Timepoint (hr)        4
|
|20001248                    Tissue                Whole Plant
|
|20001451                    Age (day)             8
|
|20001451                    Light                 Far-red vs. White
|
|20001451                    Organism              A. thaliana
|
|20001451                    Plant Line            Columbia
|
|20001451                    Timepoint (hr)        24
|
|20001451                    Tissue                Whole Plant
|
|
|SHORT_NAME: At_Germinating_Seeds
|
|-----------------
|
|EXPT_REP_ID                 PARAM_NAME            VALUE
|
|------------------------------------------------------------------------------|
|20000179                    Age (hr)              6 vs. 0
|
|20000179                    Organism              A. thaliana
|
|20000179                    Plant Line            WS
|
|20000179                    Tissue                Germinating Seeds
|
|20000180                    Age (hr)              24 vs. 0
|
|20000180                    Organism              A. thaliana
|
```

-continued

| EXPT_REP_ID | PARAM_NAME | VALUE |
|---|---|---|
| 20000180 | Plant Line | WS |
| 20000180 | Tissue | Germinating Seeds |
| 108464 | Age (day) | 4 vs. 0 |
| 108464 | Tissue | Germinating Seeds |

SHORT_NAME: At_Guard_Cells

| EXPT_REP_ID | PARAM_NAME | VALUE |
|---|---|---|
| 20000495 | Harvest Date | Aug. 2, 2002 |
| 20000495 | Organism | *A. thaliana* |
| 20000495 | Tissue | Guard Cells vs. Leaves |

SHORT_NAME: At_Herbicide_Mutants

| EXPT_REP_ID | PARAM_NAME | VALUE |
|---|---|---|
| 20000639 | Plant Line | 05377RR/BR27173 |
| 20000639 | Timepoint (hr) | 4 |
| 20000639 | Tissue | Seedlings |
| 20000639 | Treatment | Roundup vs. No Treatment |
| 20000640 | Plant Line | 05377RR/BR27173 |
| 20000640 | Timepoint (hr) | 12 |
| 20000640 | Tissue | Seedlings |
| 20000640 | Treatment | Roundup vs. No Treatment |

SHORT_NAME: At_Interploidy_Crosses

| EXPT_REP_ID | PARAM_NAME | VALUE |
|---|---|---|
| 20001853 | Age (day) | 5 |
| 20001853 | Cross | Fis1 vs. 2X × 2X |
| 20001853 | Organism | *A. thaliana* |
| 20001853 | Plant Line | Columbia |
| 20001853 | Tissue | Siliques |

SHORT_NAME: At_Ler-pi_Ovule

| EXPT_REP_ID | PARAM_NAME | VALUE |
|---|---|---|
| 108595 | Plant Line | Ler_pi |
| 108595 | Tissue | Ovules |

```
|SHORT_NAME: At_Ler-rh1_Root
|
|----------------
|
|EXPT_REP_ID            PARAM_NAME          VALUE
|
|-------------------------------------------------------------------------|
|108594                 Plant Line          Ler_rh1
|
|108594                 Tissue              Roots
|
|
|SHORT_NAME: At_Line_Comparisons_NA
|
|----------------
|
|EXPT_REP_ID            PARAM_NAME          VALUE
|
|-------------------------------------------------------------------------|
|20001097               Plant Line          BR13138-A2 vs. WS
|
|20001163               Plant Line          ME01604-04 vs. WS
|
|
|SHORT_NAME: At_Line_Comparisons
|
|----------------
|
|EXPT_REP_ID            PARAM_NAME          VALUE
|
|-------------------------------------------------------------------------|
|20001184               Plant Line          ME01848-01 vs. WS
|
|20001300               Plant Line          ME01338-05 vs. WS
|
|20001347               Plant Line          ME01604-01 vs. WS
|
|20002009               Plant Line          ME01642 vs. WS
|
|
|SHORT_NAME: At_Open_Flower
|
|----------------
|
|EXPT_REP_ID            PARAM_NAME          VALUE
|
|-------------------------------------------------------------------------|
|20000264               Age (day)           21
|
|20000264               Organism            A. thaliana
|
|20000264               Plant Line          WS
|
|20000264               Tissue              Open Flower vs. Whole Plant
|
|20000265               Age (day)           21
|
|20000265               Organism            A. thaliana
|
|20000265               Plant Line          WS
|
|20000265               Tissue              Closed Flower vs. Whole Plant
|
|20000286               Age (day)           21
|
|20000286               Organism            A. thaliana
|
```

```
                              -continued
|20000286                  Plant Line          WS
|
|20000286                  Tissue              Half Open vs. Whole Plant
|
|
|
|SHORT_NAME: At_Petals
|
|----------------
|
|EXPT_REP_ID               PARAM_NAME          VALUE
|
|------------------------------------------------------------------------|
|20000794                  Age (day)           23-25 days
|
|20000794                  Organism            A. thaliana
|
|20000794                  Plant Line          WS
|
|20000794                  Tissue              Petals vs. Whole plant
|
|
|
|SHORT_NAME: At_Pollen
|
|----------------
|
|EXPT_REP_ID               PARAM_NAME          VALUE
|
|------------------------------------------------------------------------|
|20000326                  Age (day)           0 vs. 21
|
|20000326                  Organism            A. thaliana
|
|20000326                  Plant Line          WS
|
|20000326                  Tissue              Pollen vs. Whole Plant
|
|
|
|SHORT_NAME: At_Root_Tips
|
|----------------
|
|EXPT_REP_ID               PARAM_NAME          VALUE
|
|------------------------------------------------------------------------|
|  108434                  Age (day)           21
|
|  108434                  Organism            A. thaliana
|
|  108434                  Plant Line          WS
|
|  108434                  Tissue              Root Tips vs. Root Tops
|
|
|
|SHORT_NAME: At_Roots
|
|----------------
|
|EXPT_REP_ID               PARAM_NAME          VALUE
|
|------------------------------------------------------------------------|
|20000185                  Age (day)           7 vs. 21
|
|20000185                  Organism            A. thaliana
|
|20000185                  Plant Line          WS
|
|20000185                  Tissue              Roots vs. Whole Plant
|
|20000439                  Age (day)           14 vs. 21
|
|20000439                  Organism            A. thaliana
|
```

```
-continued
|20000439                       Plant Line              WS
|
|20000439                       Tissue                  Roots vs. Whole Plant
|
|
|
|SHORT_NAME: At_Shoot_Apices
|
|-----------------
|
|EXPT_REP_ID                    PARAM_NAME              VALUE
|
|---------------------------------------------------------------------------|
|  108480                       Plant Line              Ws-2
|
|  108480                       Treatment               1 uM BR vs. No Treatment
|
|  108481                       Plant Line              Ws-2
|
|  108481                       Treatment               1 uM BRZ vs. No Treatment
|
|
|
|SHORT_NAME: At_Shoots
|
|-----------------
|
|EXPT_REP_ID                    PARAM_NAME              VALUE
|
|---------------------------------------------------------------------------|
|20000184                       Age (day)               7 vs. 21
|
|20000184                       Organism                A. thaliana
|
|20000184                       Plant Line              WS
|
|20000184                       Tissue                  Shoots vs. Whole Plant
|
|20000438                       Age (day)               14 vs. 21
|
|20000438                       Organism                A. thaliana
|
|20000438                       Plant Line              WS
|
|20000438                       Tissue                  Shoots vs. Whole Plant
|
|
|
|SHORT_NAME: At_Siliques
|
|-----------------
|
|EXPT_REP_ID                    PARAM_NAME              VALUE
|
|---------------------------------------------------------------------------|
|20000234                       Age (day)               21
|
|20000234                       Organism                A. thaliana
|
|20000234                       Plant Line              WS
|
|20000234                       Tissue                  <5 mm Siliques vs. Whole Plant
|
|20000236                       Age (day)               21
|
|20000236                       Organism                A. thaliana
|
|20000236                       Plant Line              WS
|
|20000236                       Tissue                  >10 mm Siliques vs. Whole Plant
|
|
```

-continued

```
|
|SHORT_NAME: At_Wounding
|
|-----------------
|
|EXPT_REP_ID              PARAM_NAME            VALUE
|
|------------------------------------------------------------------------|
|  108574                 Age (day)             14
|
|  108574                 Organism              A. thaliana
|
|  108574                 Plant Line            WS
|
|  108574                 Timepoint (hr)        1
|
|  108574                 Tissue                Aerial
|
|  108574                 Treatment             Wounding vs. No Wounding
|
|  108575                 Age (day)             14
|
|  108575                 Organism              A. thaliana
|
|  108575                 Plant Line            WS
|
|  108575                 Timepoint (hr)        6
|
|  108575                 Tissue                Aerial
|
|  108575                 Treatment             Wounding vs. No Wounding
|
|
|
|SHORT_NAME: At_stm_Mutants
|
|-----------------
|
|EXPT_REP_ID              PARAM_NAME            VALUE
|
|------------------------------------------------------------------------|
|  108435                 Plant Line            wt Landsburg vs stm
|
|  108435                 Tissue                Shoot Apical Meristem Region
|
|
|
|_____|
```

```
|_____
|Promoter YP0107
|
|_____|
|Modulates the gene: fatty acid elongase 1; FAE1
|
|_____|
|The GenBank description of the gene: NM_119617 Arabidopsis thaliana fatty acid|
| elongase 1 (FAE1) (At4g34520) mRNA, complete cds, gi|30690063|ref|NM_119617.2|
||[30690063]
|
|_____|
|The predicted promoter sequence:
|
|5'taacaatccttgggaacattgcatccatagatatccggttaagatcgatctttgaactcataaaaactagtagatt|
|ggttggttggtttccatgtaccagaaggcttaccctattagttgaaagttgaaactttgttccctactcaattcctag|
|ttgtgtaaatgtatgtatatgtaatgtgtataaaacgtagtacttaaatgactaggagtggttcttgagaccgatgag|
|agatggggagcagaactaaagatgatgacataattaagaacgaatttgaaaggctcttaggtttgaatcctattcgaga|
|atgtttttgtcaaagatagtggcgattttgaaccaaagaaaacatttaaaaaatcagtatccggttacgttcatgcaa|
|atagaaagtggtctaggatctgattgtaattttagacttaaagagtctcttaagattcaatcctggctgtgtacaaaa|
|ctacaaataatatatttttagactatttggccttaactaaacttccactcattatttactgaggttagagaatagctt|
|gcgaataaacacattcccgagaaatactcatgatcccataattagtcagagggtatgccaatcagatctaagaacaca|
|cattccctcaaattttaatgcacatgtaatcatagtttagcacaattcaaaaataatgtagtattaaagacagaaatt|
```

-continued

```
tgtagactttttttttggcgttaaaagaagactaagtttatacgtacattttattttaagtggaaaaccgaaattttcc
atcgaaatatatgaatttagtatatatatttctgcaatgtactattttgctattttggcaactttcagtggactacta
ctttattacaatgtgtatggatgcatgagtttgagtatacacatgtctaaatgcatgctttgtaaaacgtaacggacc
acaaaagaggatccatacaaatacatctcatagcttcctccattattttccgacacaaacagagca3'-aATG
```

The promoter was cloned from the organism:

*Arabidopsis thaliana*, WS ecotype

The experimental promoter sequence:

```
taacAATCCTTGGGAACATtgcatCCATAGATATCCGGTTAAGATCGATCTTTGAACTCATAAAAACTAGTAGATTGG
TTGGTTGGTTTCCATGTACCAGAAGGCTTACCCTATTAGTTGAAAGTTGAAACTTTGTtccctaCTCAATTCCTAGTT
GTGTAAATGTATGTATATGTAATGTGTATAAAACGTAGTACTTAAATGACTAGGAGTGGTTCTTGAGACCGATGAGAG
ATGGGAGCAGAACTAAAGATGATGACATAATTAAGAACGAATTTGAAAGGCTCTTAGGTTTGAATCCTATTCGAGAAT
GTTTTTGTCAAAGATAGTGGCGATTTTGAACCAAAGAAAACATTTAAAAAATCAGTATCcggttaCGTTCATGCAAAT
AGAAagtggtctAGGATCTGATtgtaatTTTAGACTTAAAGAGtctctTAAGATTCAATCCTGGCTGTGTACAAAACT
AC
```

The promoter was cloned in the vector: pNewbin4-HAP1-GFP

When cloned into the vector the promoter was operably linked to a marker which was the type: X GFP-ER Promoter-marker was tested in:

*Arabidopsis thaliana*, WS ecotype

Generation Screened: (X)T1 Mature (X)T2 Seedling (X)T2 Mature (X)T3 Seedling

The spatial expression of the promoter-marker vector was found, observed in and would be useful in expression in any or all of the following:

Embryo                         H late H mature

Observed expression pattern of the promoter-marker vector was in:

Low levels of GFP expression were detected in late torpedo stage (not shown) with highest levels in the mature and late embryo High GFP expression was detected in late endosperm stage in endothelium layer of developing seed T2 mature: Same as T1 mature T3 seedling: GFP was detected in a few root hairs not observed in T2 seedlings Misc. promoter information:

Bidirectionality:NO Exons:NO Repeats:Not Done

An overlap in an exon with the endogenous coding sequence to the promoter occurs at base pairs

N/A

The Ceres cDNA ID of the endogenous coding sequence to the promoter: 12656458

-continued cDNA nucleotide sequence:

```
ATGACGTCCGTTAACGTTAAGCTCCTTTACCGTTACGTCTTAACCAACTTTTTCAACCTCTGTTTGTTCCCGTTAACG
GCGTTCCTCGCCGGAAAAGCCTCTCGGCTTACCATAAACGATCTCCACAACTTCCTTTCCTATCTCCAACACAACCTT
ATAACAGTAACTTTACTCTTTGCTTTCACTGTTTTCGGTTTGGTTCTCTACATCGTAACCCGACCCAATCCGGTTTAT
CTCGTTGACTACTCGTGTTACCTTCCACCACCGCATCTCAAAGTTAGTGTCTCTAAAGTCATGGATATTTTCTACCAA
ATAAGAAAAGCTGATACTTCTTCACGGAACGTGGCATGTGATGATCCGTCCTCGCTCGATTTCCTGAGGAAGATTCAA
GAGCGTTCAGGTCTAGGTGATGAGACGTACAGTCCTGAGGGACTCATTCACGTACCACCGCGGAAGACTTTTGCAGCG
TCACGTGAAGAGACAGAGAAGGTTATCATCGGTGCGCTCGAAAACTTATTCGAGAGACACCAAAGTTAACCCTAGAGAG
ATTGGTATACTTGTGGTGAACTCAAGCATGTTTAATCCAACTCCTTCGCTATCCGCTATGGTCGTTAATACTTTCAAG
CTCCGAAGCAACATCAAAAGCTTTAATCTAGGAGGAATGGGTTGTAGTGCTGGTGTTATTGCCATTGATTTGGCTAAA
GACTTGTTGCATGTTCATAAAAACACTTATGCTCTTGTGGTGAGCACTGAGAACATCACACAAGGCATTTATGCTGGA
GAAAATAGATCAATGATGGTTAGCAATTGCTTGTTTCGTGTTGGTGGGGCCGCGATTTTGCTCTCTAACAAGTCGGGA
GACCGGAGACGGTCCAAGTACAAGCTAGTTCACACGGTCCGAACGCATACTGGAGCTGATGACAAGTCTTTTCGATGT
GTGCAACAAGAAGACGATGAGAGCGGCAAAATCGGAGTTTGTCTGTCAAAGGACATAACCAATGTTGCGGGGACAACA
CTTACGAAAATATAGCAACATTGGGTCCGTTGATTCTTCCTTTAAGCGAAAAGTTTCTTTTTTTCGCTACCTTCGTC
GCCAAGAAACTTCTAAAGGATAAAATCAAGCATTACTATGTTCCGGATTTCAAGCTTGCTGTTGACCATTTCTGTATT
CATGCCGGAGGCAGAGCCGTGATCGATGAGCTAGAGAAGAACTTAGGACTATCGCCGATCGATGTGGAGGCATCTAGA
TCAACGTTACATAGATTTGGGAATACTTCATCTAGCTCAATTTGGTATGAATTAGCATACATAGAGGCAAAGGGAAGA
ATGAAGAAGGGAATAAAGCTTGGCAGATTGCTTTAGGATCAGGGTTTAAGTGTAATAGTGCGGTTTGGGTGGCTCTA
CGCAATGTCAAGGCATCGGCAAATAGTCCTTGGCAACATTGCATCGATAGATATCCGGTTAAAATTGATTCTGATTTG
TCAAAGTCAAAGACTCATGTCCAAAACGGTCGGTCCTAA
```

Coding Sequence:

```
MTSVNVKLLYRYVLTNFFNLCLFPLTAFLAGKASRLTINDLHNFLSYLQHNLITVTLLFAFTVFGLVLYIVTRPNPVY
LVDYSCYLPPPHLKVSVSKVMDIFYQIRKADTSSRNVACDDPSSLDFLRKIQERSGLGDETYSPEGLIHVPPRKTFAA
SREETEKVIIGALENLFENTKVNPREIGILVVNSSMFNPTPSLSAMVVNTFKLRSNIKSFNLGGMGCSAGVIAIDLAK
DLLHVHKNTYALVVSTENITQGIYAGENRSMMVSNCLFRVGGAAILLSNKSGDRRRSKYKLVHTVRTHTGADDKSFRC
VQQEDDESGKIGVCLSKDITNVAGTTLTKNIATLGPLILPLSEKFLFFATFVAKKLLKDKIKHYYVPDFKLAVDHFCI
HAGGRAVIDELEKNLGLSPIDVEASRSTLHRFGNTSSSSIWYELAYIEAKGRMKKGNKAWQIALGSGFKCNSAVWVAL
RNVKASANSPWQHCIDRYPVKIDSDLSKSKTHVQNGRS*
```

Microarray data shows that the coding sequence was expressed in the following experiments, which shows that the promoter would be useful to modulate expression in situations similar to the following:

CDNA_ID: 12656458

------------------

| SHORT_NAME | EXPT_REP_ID | IS_UP |
|---|---|---|
| At_18 percent_PEG_Hydroponic | 20001956 | + |
| At_50 mM_NH4NO3_L-to-H | 20001759 | - |
| At_Drought-Air-Dry | 20002255 | - |
| At_Drought_Reproduction | 20001906 | + |
| At_Drought_Reproduction | 20001908 | + |
| At_Interploidy_Crosses | 20001316 | - |
| At_Interploidy_Crosses | 20001317 | + |
| At_Interploidy_Crosses | 20001653 | - |
| At_Interploidy_Crosses | 20001853 | - |

The parameters for the microarray experiments listed above by Expt_Rep_ID and Short_name are as follow below:

CDNA_ID: 12656458

------------------

-continued

SHORT_NAME: At_18 percent_PEG_Hydroponic

| EXPT_REP_ID | PARAM_NAME | VALUE |
|---|---|---|
| 20001956 | Age (day) | 35 |
| 20001956 | Organism | A. thaliana |
| 20001956 | Plant Line | WS |
| 20001956 | Timepoint (hr) | 4 |
| 20001956 | Tissue | Shoots |
| 20001956 | Treatment | 18 percent PEG vs. No Treatment |

SHORT_NAME: At_50 mM_NH4NO3_L-to-H

| EXPT_REP_ID | PARAM_NAME | VALUE |
|---|---|---|
| 20001759 | Age (day) | 28 |
| 20001759 | Organism | A. thaliana |
| 20001759 | Plant Line | WS |
| 20001759 | Timepoint (hr) | 1 |
| 20001759 | Tissue | Siliques |
| 20001759 | Treatment | 50 mM NH4NO3 vs 100 mM Mannitol |

SHORT_NAME: At_Drought-Air-Dry

| EXPT_REP_ID | PARAM_NAME | VALUE |
|---|---|---|
| 20002255 | Age (day) | 35 |
| 20002255 | Organism | A. thaliana |
| 20002255 | Plant Line | WS |
| 20002255 | Timepoint (hr) | 1 |
| 20002255 | Tissue | Shoots |
| 20002255 | Treatment | Drought vs. No Drought |

SHORT_NAME: At_Drought_Reproduction

| EXPT_REP_ID | PARAM_NAME | VALUE |
|---|---|---|
| 20001906 | Age (day) | 35 |
| 20001906 | Organism | A. thaliana |
| 20001906 | Plant Line | WS |
| 20001906 | Timepoint (day) | 5 |

-continued

```
|20001906                    Tissue             Siliques
|
|20001906                    Treatment          Drought vs. No Drought
|
|20001908                    Age (day)          40
|
|20001908                    Organism           A. thaliana
|
|20001908                    Plant Line         WS
|
|20001908                    Timepoint (day)    10
|
|20001908                    Tissue             Siliques
|
|20001908                    Treatment          Drought vs. No Drought
|
|
|SHORT_NAME: At_Interploidy_Crosses
|
|----------------
|
|EXPT_REP_ID                 PARAM_NAME         VALUE
|
|------------------------------------------------------------------------|
|20001316                    Age (day)          5
|
|20001316                    Cross              hemi × 2X vs. 2X × 2X
|
|20001316                    Organism           A. thaliana
|
|20001316                    Plant Line         Columbia
|
|20001316                    Tissue             Siliques
|
|20001317                    Age (day)          5
|
|20001317                    Cross              2X × hemi vs. 2X × 2X
|
|20001317                    Organism           A. thaliana
|
|20001317                    Plant Line         Columbia
|
|20001317                    Tissue             Siliques
|
|20001653                    Age (day)          5
|
|20001653                    Cross              2X × 6X vs. 2X × 2X
|
|20001653                    Organism           A. thaliana
|
|20001653                    Plant Line         Columbia
|
|20001653                    Tissue             Siliques
|
|20001853                    Age (day)          5
|
|20001853                    Cross              Fis1 vs. 2X × 2X
|
|20001853                    Organism           A. thaliana
|
|20001853                    Plant Line         Columbia
|
|20001853                    Tissue             Siliques
|
|
|
|_____|
```

TABLE 2

Promoter Utilities Based on Differential Expression Experiments

| EXPT_REP_ID | SHORT_NAME | UTILITY |
|---|---|---|
| 20000166 | At_100uM_ABA | Promoters and cDNAs corresponding to endogenous cDNAs which were differentially expressed in this experiment would be useful in modulating ABA, stress, and drought induced and/or regulated responses |
| 20000169 | At_100uM_ABA | Promoters and cDNAs corresponding to endogenous cDNAs which were differentially expressed in this experiment would be useful in modulating ABA, stress, and drought induced and/or regulated responses |
| 20000171 | At_42deg_Heat | Promoters and cDNAs corresponding to endogenous cDNAs which were differentially expressed in this experiment would be useful in modulating stress, heat and cold induced and/or regulated responses |
| 20000173 | At_42deg_Heat | Promoters and cDNAs corresponding to endogenous cDNAs which were differentially expressed in this experiment would be useful in modulating stress, heat and cold induced and/or regulated responses |
| 20000179 | At_Germinating_Seeds | Promoters and cDNAs corresponding to endogenous cDNAs which were differentially expressed in this experiment would be useful for modulating growth, yield and plant development |
| 20000180 | At_Germinating_Seeds | Promoters and cDNAs corresponding to endogenous cDNAs which were differentially expressed in this experiment would be useful for modulating growth, yield and plant development |
| 20000182 | At_2mM_SA | Promoters and cDNAs corresponding to endogenous cDNAs which were differentially expressed in this experiment would be useful in modulating stress and SA induced and/or regulated responses |
| 20000184 | At_Shoots | Promoters and cDNAs corresponding to endogenous cDNAs which were differentially expressed in this experiment would be useful for modulating growth, yield, and plant development for instance in roots and/or shoots |
| 20000185 | At_Roots | Promoters and cDNAs corresponding to endogenous cDNAs which were differentially expressed in this experiment would be useful for modulating growth, yield, and plant development for instance in roots and/or shoots |
| 20000227 | At_Root-Tips-vs-Tops | Promoters and cDNAs corresponding to endogenous cDNAs which were differentially expressed in this experiment would be useful for modulating growth, yield, and plant development for instance in roots and/or shoots |
| 20000234 | At_Siliques | Promoters and cDNAs corresponding to endogenous cDNAs which were differentially expressed in this experiment would be useful for modulating fertility, fruit and seed size, number and/or yield |
| 20000235 | At_Siliques | Promoters and cDNAs corresponding to endogenous cDNAs which were differentially expressed in this experiment would be useful for modulating fertility, fruit and seed size, number and/or yield |
| 20000264 | At_Open_Flower | Promoters and cDNAs corresponding to endogenous cDNAs which were differentially expressed in this experiment would be useful for modulating fertility, fruit and seed size, number and/or yield, including flowers development and number |
| 20000265 | At_Open_Flower | Promoters and cDNAs corresponding to endogenous cDNAs which were differentially expressed in this experiment would be useful for modulating fertility, fruit and seed size, number and/or yield, including flowers development and number |

TABLE 2-continued

Promoter Utilities Based on Differential Expression Experiments

| EXPT_REP_ID | SHORT_NAME | UTILITY |
|---|---|---|
| 20000267 | At_Drought | Promoters and cDNAs corresponding to endogenous cDNAs which were differentially expressed in this experiment would be useful for modulating stress and drought tolerance |
| 20000286 | At_Open_Flower | Promoters and cDNAs corresponding to endogenous cDNAs which were differentially expressed in this experiment would be useful for modulating fertility, fruit and seed size, number and/or yield, including flowers development and number |
| 20000436 | At_Drought | Promoters and cDNAs corresponding to endogenous cDNAs which were differentially expressed in this experiment would be useful for modulating stress and drought tolerance |
| 20000437 | At_Drought | Promoters and cDNAs corresponding to endogenous cDNAs which were differentially expressed in this experiment would be useful for modulating stress and drought tolerance |
| 20000438 | At_Shoots | Promoters and cDNAs corresponding to endogenous cDNAs which were differentially expressed in this experiment would be useful for modulating growth, yield, and plant development for instance in roots and/or shoots |
| 20000439 | At_Roots | Promoters and cDNAs corresponding to endogenous cDNAs which were differentially expressed in this experiment would be useful for modulating growth, yield, and plant development for instance in roots and/or shoots |
| 20000441 | At_1uM_BR-BRZ | Promoters and cDNAs corresponding to endogenous cDNAs which were differentially expressed in this experiment would be useful for modulating growth, yield and BR induced and/regulated responses |
| 20000443 | At_1uM_BR-BRZ | Promoters and cDNAs corresponding to endogenous cDNAs which were differentially expressed in this experiment would be useful for modulating growth, yield and BR induced and/regulated responses |
| 20000451 | At_CS6879_Shoots-Roots | Promoters and cDNAs corresponding to endogenous cDNAs which were differentially expressed in this experiment would be useful for modulating growth, yield, and plant development for instance in roots and/or shoots |
| 20000453 | At_100uM_ABA | Promoters and cDNAs corresponding to endogenous cDNAs which were differentially expressed in this experiment would be useful in modulating ABA, stress, and drought induced and/or regulated responses |
| 20000457 | At_42deg_Heat | Promoters and cDNAs corresponding to endogenous cDNAs which were differentially expressed in this experiment would be useful in modulating stress, heat and cold induced and/or regulated responses |
| 20000458 | At_42deg_Heat | Promoters and cDNAs corresponding to endogenous cDNAs which were differentially expressed in this experiment would be useful in modulating stress, heat and cold induced and/or regulated responses |
| 20000460 | At_10percent_PEG | Promoters and cDNAs corresponding to endogenous cDNAs which were differentially expressed in this experiment would be useful for modulating stress, drought tolerance, and osmotic stress |
| 20000495 | At_Guard_Cells | Promoters and cDNAs corresponding to endogenous cDNAs which were differentially expressed in this experiment would be useful for modulating guard cells, drought and stress tolerance |
| 20000527 | At_10percent_PEG | Promoters and cDNAs corresponding to endogenous cDNAs which were differentially expressed in this experiment would be useful for modulating stress, drought tolerance, and osmotic stress |

TABLE 2-continued

Promoter Utilities Based on Differential Expression Experiments

| EXPT_REP_ID | SHORT_NAME | UTILITY |
| --- | --- | --- |
| 20000573 | At_100uM_ABA_Mutants | Promoters and cDNAs corresponding to endogenous cDNAs which were differentially expressed in this experiment would be useful in modulating ABA, stress, and drought induced and/or regulated responses |
| 20000574 | At_100uM_ABA_Mutants | Promoters and cDNAs corresponding to endogenous cDNAs which were differentially expressed in this experiment would be useful in modulating ABA, stress, and drought induced and/or regulated responses |
| 20000709 | At_15mM_NH4NO3_L-to-H | Promoters and cDNAs corresponding to endogenous cDNAs which were differentially expressed in this experiment would be useful for modulating growth, yield and nitrogen induced and/regulated responses |
| 20000794 | At_Petals | Promoters and cDNAs corresponding to endogenous cDNAs which were differentially expressed in this experiment would be useful for modulating fertility, fruit and seed size, number and/or yield, including flowers development and number |
| 20001151 | At_Line_Comparisons | Promoters and cDNAs corresponding to endogenous cDNAs which were differentially expressed in this experiment would be useful for modulating alkaloid biosynthesis and alkaloid induced and/or regulated responses |
| 20001184 | At_Line_Comparisons | Promoters and cDNAs corresponding to endogenous cDNAs which were differentially expressed in this experiment would be useful for modulating methyl jasmonate induced and/or regulated responses including biosynthesis. They are useful also to modulate stress responses. |
| 20001195 | At_Line_Comparisons | Promoters and cDNAs corresponding to endogenous cDNAs which were differentially expressed in this experiment would be useful for modulating alkaloid biosynthesis and alkaloid induced and/or regulated responses |
| 20001247 | At_Far-red-induction | Promoters and cDNAs corresponding to endogenous cDNAs which were differentially expressed in this experiment would be useful for modulating shade avoidance |
| 20001248 | At_Far-red-induction | Promoters and cDNAs corresponding to endogenous cDNAs which were differentially expressed in this experiment would be useful for modulating shade avoidance |
| 20001307 | At_Line_Comparisons | Promoters and cDNAs corresponding to endogenous cDNAs which were differentially expressed in this experiment would be useful for modulating alkaloid biosynthesis and alkaloid induced and/or regulated responses |
| 20001308 | At_Line_Comparisons | Promoters and cDNAs corresponding to endogenous cDNAs which were differentially expressed in this experiment would be useful for modulating alkaloid biosynthesis and alkaloid induced and/or regulated responses |
| 20001309 | At_Line_Comparisons | Promoters and cDNAs corresponding to endogenous cDNAs which were differentially expressed in this experiment would be useful for modulating alkaloid biosynthesis and alkaloid induced and/or regulated responses |
| 20001310 | At_Line_Comparisons | Promoters and cDNAs corresponding to endogenous cDNAs which were differentially expressed in this experiment would be useful for modulating alkaloid biosynthesis and alkaloid induced and/or regulated responses |
| 20001318 | At_Line_Comparisons | Promoters and cDNAs corresponding to endogenous cDNAs which were differentially expressed in this experiment would be useful for modulating alkaloid biosynthesis and alkaloid induced and/or regulated responses |
| 20001319 | At_Line_Comparisons | Promoters and cDNAs corresponding to endogenous cDNAs which were differentially expressed in this experiment would be useful for modulating alkaloid biosynthesis and alkaloid induced and/or regulated responses |

TABLE 2-continued

Promoter Utilities Based on Differential Expression Experiments

| EXPT_REP_ID | SHORT_NAME | UTILITY |
| --- | --- | --- |
| 20001347 | At_Line_Comparisons | Promoters and cDNAs corresponding to endogenous cDNAs which were differentially expressed in this experiment would be useful for modulating methyl jasmonate induced and/or regulated responses including biosynthesis. They are useful also to modulate stress responses. |
| 20001450 | At_Far-red-induction | Promoters and cDNAs corresponding to endogenous cDNAs which were differentially expressed in this experiment would be useful for modulating shade avoidance |
| 20001451 | At_Far-red-induction | Promoters and cDNAs corresponding to endogenous cDNAs which were differentially expressed in this experiment would be useful for modulating shade avoidance |
| 20001458 | At_50mM_NH4NO3_L-to-H | Promoters and cDNAs corresponding to endogenous cDNAs which were differentially expressed in this experiment would be useful for modulating growth, yield and nitrogen induced and/regulated responses |
| 20001504 | At_Far-red-enriched | Promoters and cDNAs corresponding to endogenous cDNAs which were differentially expressed in this experiment would be useful for modulating shade avoidance |
| 20001554 | At_Drought_Soil_Dry | Promoters and cDNAs corresponding to endogenous cDNAs which were differentially expressed in this experiment would be useful for modulating stress and drought tolerance |
| 20001555 | At_Drought_Soil_Dry | Promoters and cDNAs corresponding to endogenous cDNAs which were differentially expressed in this experiment would be useful for modulating stress and drought tolerance |
| 20001556 | At_Drought_Soil_Dry | Promoters and cDNAs corresponding to endogenous cDNAs which were differentially expressed in this experiment would be useful for modulating stress and drought tolerance |
| 20001557 | At_Drought_Soil_Dry | Promoters and cDNAs corresponding to endogenous cDNAs which were differentially expressed in this experiment would be useful for modulating stress and drought tolerance |
| 20001558 | At_Drought_Soil_Dry | Promoters and cDNAs corresponding to endogenous cDNAs which were differentially expressed in this experiment would be useful for modulating stress and drought tolerance |
| 20001559 | At_Drought_Soil_Dry | Promoters and cDNAs corresponding to endogenous cDNAs which were differentially expressed in this experiment would be useful for modulating stress and drought tolerance |
| 20001560 | At_Drought_Soil_Dry | Promoters and cDNAs corresponding to endogenous cDNAs which were differentially expressed in this experiment would be useful for modulating stress and drought tolerance |
| 20001653 | At_Interploidy_Crosses | Promoters and cDNAs corresponding to endogenous cDNAs which were differentially expressed in this experiment would be useful for modulating fertility, fruit and seed size, number and/or yield, including endosperm size and seed abortion |
| 20001654 | At_Interploidy_Crosses | Promoters and cDNAs corresponding to endogenous cDNAs which were differentially expressed in this experiment would be useful for modulating fertility, fruit and seed size, number and/or yield, including endosperm size and seed abortion |
| 20001704 | At_Interploidy_Crosses | Promoters and cDNAs corresponding to endogenous cDNAs which were differentially expressed in this experiment would be useful for modulating fertility, fruit and seed size, number and/or yield, including endosperm size and seed abortion |
| 20001757 | At_50mM_NH4NO3_L-to-H | Promoters and cDNAs corresponding to endogenous cDNAs which were differentially expressed in this experiment would be useful for modulating growth, yield and nitrogen induced and/regulated responses |

TABLE 2-continued

Promoter Utilities Based on Differential Expression Experiments

| EXPT_REP_ID | SHORT_NAME | UTILITY |
| --- | --- | --- |
| 20001768 | At_Far-red-enriched-adult | Promoters and cDNAs corresponding to endogenous cDNAs which were differentially expressed in this experiment would be useful for modulating shade avoidance |
| 20001770 | At_Far-red-enriched-adult | Promoters and cDNAs corresponding to endogenous cDNAs which were differentially expressed in this experiment would be useful for modulating shade avoidance |
| 20001771 | At_Far-red-enriched-adult | Promoters and cDNAs corresponding to endogenous cDNAs which were differentially expressed in this experiment would be useful for modulating shade avoidance |
| 20001773 | At_Far-red-enriched-adult | Promoters and cDNAs corresponding to endogenous cDNAs which were differentially expressed in this experiment would be useful for modulating shade avoidance |
| 20001853 | At_Interploidy_Crosses | Promoters and cDNAs corresponding to endogenous cDNAs which were differentially expressed in this experiment would be useful for modulating fertility, fruit and seed size, number and/or yield, including endosperm size and seed abortion |
| 20001904 | At_Drought_Reproduction | Promoters and cDNAs corresponding to endogenous cDNAs which were differentially expressed in this experiment would be useful for modulating stress and drought tolerance |
| 20001905 | At_Drought_Reproduction | Promoters and cDNAs corresponding to endogenous cDNAs which were differentially expressed in this experiment would be useful for modulating stress and drought tolerance |
| 20001906 | At_Drought_Reproduction | Promoters and cDNAs corresponding to endogenous cDNAs which were differentially expressed in this experiment would be useful for modulating stress and drought tolerance |
| 20001907 | At_Drought_Reproduction | Promoters and cDNAs corresponding to endogenous cDNAs which were differentially expressed in this experiment would be useful for modulating stress and drought tolerance |
| 20001908 | At_Drought_Reproduction | Promoters and cDNAs corresponding to endogenous cDNAs which were differentially expressed in this experiment would be useful for modulating stress and drought tolerance |
| 20001909 | At_Drought_Reproduction | Promoters and cDNAs corresponding to endogenous cDNAs which were differentially expressed in this experiment would be useful for modulating stress and drought tolerance |
| 20001910 | At_Drought_Reproduction | Promoters and cDNAs corresponding to endogenous cDNAs which were differentially expressed in this experiment would be useful for modulating stress and drought tolerance |
| 20001911 | At_Drought_Reproduction | Promoters and cDNAs corresponding to endogenous cDNAs which were differentially expressed in this experiment would be useful for modulating stress and drought tolerance |
| 20002007 | At_Line_Comparisons | Promoters and cDNAs corresponding to endogenous cDNAs which were differentially expressed in this experiment would be useful for modulating sterol biosynthesis and sterol induced and/or regulated responses. |
| 20002008 | At_Line_Comparisons | Promoters and cDNAs corresponding to endogenous cDNAs which were differentially expressed in this experiment would be useful for modulating sterol biosynthesis and sterol induced and/or regulated responses. |
| 20002009 | At_Line_Comparisons | Promoters and cDNAs corresponding to endogenous cDNAs which were differentially expressed in this experiment would be useful for modulating sterol biosynthesis and sterol induced and/or regulated responses. |
| 20002010 | At_Line_Comparisons | Promoters and cDNAs corresponding to endogenous cDNAs which were differentially expressed in this experiment would be useful for modulating sterol biosynthesis and sterol induced and/or regulated responses. |

TABLE 2-continued

Promoter Utilities Based on Differential Expression Experiments

| EXPT_REP_ID | SHORT_NAME | UTILITY |
|---|---|---|
| 20002012 | At_Line_Comparisons | Promoters and cDNAs corresponding to endogenous cDNAs which were differentially expressed in this experiment would be useful for modulating triterpene biosynthesis and triterpene induced and/or regulated responses. |
| 20002103 | At_8deg_Cold | Promoters and cDNAs corresponding to endogenous cDNAs which were differentially expressed in this experiment would be useful in modulating stress, heat and cold induced and/or regulated responses |
| 20002107 | At_8deg_Cold | Promoters and cDNAs corresponding to endogenous cDNAs which were differentially expressed in this experiment would be useful in modulating stress, heat and cold induced and/or regulated responses |

TABLE 3

| Promoter Name | Fl | Si | Lf | St | Em | Ov | Hy | Co | Rt |
|---|---|---|---|---|---|---|---|---|---|
| YP0226 | Y | Y | | | | | Y | Y | Y |
| YP0244 | Y | | | | | | | | |
| YP0286 | Y | | | Y | | | Y | Y | Y |
| YP0289 | Y | | | | | Y | | Y | Y |
| YP0356 | Y | Y | | Y | | Y | Y | Y | Y |
| YP0374 | | | | | | Y | Y | | Y |
| YP0377 | Y | | | | | | Y | Y | Y |
| YP0380 | Y | Y | Y | Y | | | Y | Y | Y |
| YP0381 | Y | | | | | | Y | | Y |
| YP0382 | Y | | | | | | | | Y |
| YP0388 | Y | Y | Y | | Y | | | | Y |
| YP0396 | Y | Y | Y | | Y | | | | Y |
| PT0506 | Y | | | | | | | | |
| PT0511 | Y | | | | | | | Y | Y |
| YP0275 | | | | | | | | | Y |
| YP0337 | | | | | | | | | Y |
| YP0384 | | | | | | | | | Y |
| YP0385 | Y | Y | | | | | | | Y |
| YP0371 | Y | | | | | | | | Y |

Legend for Table 3
Fl    Flower
Si    Silique
Lf    Leaf
St    Stem
Em    Embryo
Ov    Ovule
Hy    Hypocotyl
Co    Cotyledon
Rt    Rosette Leaf The invention being thus described, it will be apparent to one of ordinary skill in the art that various modifications of the materials and methods for practicing the invention can be made. Such modifications are to be considered within the scope of the invention as defined by the following claims.

Each of the references from the patent and periodical literature cited herein is hereby expressly incorporated in its entirety by such citation.

SEQUENCE LISTING (919 sequences)

SEQ ID NO: 1 - DNA, 19 bp, Artificial Sequence
  Synthetic oligo(dT)18 primer
ttttttttttttttttttv

SEQ ID NO: 2 - DNA, 19 bp, Artificial Sequence
  Synthetic oligo dTV primer
  misc_feature (19)..(19): n is a, c, or g
ttttttttttttttttttn

SEQ ID NO: 3 - DNA, 1013 bp, Arabidopsis thaliana
  misc_feature (1)..(1013): Ceres PROMOTER  YP0396
ctaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgaccaaaagaacatctttccttcgaattttctttcattaacatttcttttacttgtctccttgtgtcttcacttcacatcacaac

SEQ ID NO: 4 - DNA, 949 bp, Arabidopsis thaliana
  misc_feature: Encoded by SEQ ID NO: 3
  misc_feature (1)..(949): Ceres CDNA ID no. 12646726
  misc_feature (1)..(949): Sequence of endogenous gene to Ceres PROMOTER  YP0396
actacacccaaaagaacatctttccttcgaattttctttcaattaacatttcttttacttgtctccttgtgtcttcacttcacatcacaacatggctttgaagacagttttcgtagcttttatgattctccttgccatctattcgcaaacgacgtttggggacgatgtgaagtgcgagaatctggatgaaaacacgtgtgccttcgcggtctcgtccactggaaaacgttgcgttttggagaagagcatgaagaggagcgggatcgaggtgtacacatgtcgatcatcggagatagaagctaacaaggtcacaaacattattgaatcggacgagtgcattaaagcgtgtggtctagaccggaaagctttaggtatatcttcggacgcattgttggaatctcagttcacacataaactctgctcggttaaatgcttaaaccaatgtcctaacgtagtcgatctctacttcaaccttgctgctggtgaaggagtgtatttaccaaagctatgtgaatcacaagaagggaagtcaagaagagcaatgtcggaaattaggagctcgggaattgcaatggacactcttgcaccggttggaccagtcatgttgggcgagatagcacctgagccggctacttcaatggacaacatgccttacgtgccggcaccttcaccgtattaattaaggcaagggaaaatggagaggacacgtatgatatcatgagttttcgacgagaataattaagagatttatgtttagttcgacggttttagtattacatcgtttattgcgtccttatatatatgtacttcataaaaacacaccacgacacattaagagatggtgaaagtaggctgcgttctggtgtaacttttacacaagtaacgtcttataatatatatgattcgaataaaatgttgagttttggtgaaaatatataatatgtttctg

SEQ ID NO: 5 - protein, 195 aa, Arabidopsis thaliana
  misc_feature (1)..(195): Ceres CDNA ID no. 12646726
  misc_feature (1)..(195): Sequence of endogenous gene to Ceres PROMOTER  YP0396
MALKTVFVAFMILLAIYSQTTFGDDVKCENLDENTCAFAVSSTGKRCVLEKSMKRSGIEVYTCRSSEIEANKVTNIIESDECIKACGLDRKALGISSDALLESQFTHKLCSVKCLNQCPNVVDLYFNLAAGEGVYLPKLCESQEGKSRRAMSEIRSSGIAMDTLAPVGPVMLGEIAPEPATSMDNMPYVPAPSPY

SEQ ID NO: 6 - DNA, 963 bp, Arabidopsis thaliana
  misc_feature (1)..(963): Ceres PROMOTER  YP0388
tatttgtagtgacatattctacaattatcacatttttctcttatgtttcgtagtcgcagatggtcaattttttctataataatttgtccttgaacacaccaaactttagaaacgatgatatataccgtattgtcacgctcacaatgaaacaaacgcgatgaatcgtcatcaccagctaaaagcctaaaacaccatcttagttttcactcagataaaaagattatttgtttccaacctttctattgaattgattagcagtgatgacgtaattagtgatagtttatagtaaaacaaatggaagtggtaataaatttacacaacaaaatatggtaagaatctataaaataagaggttaagagatctcatgttatattaaatgattgaaagaaaaacaaactattggttgatttccatatgtaatagtaagttgtgatgaaagtgatgacgtaattagttgtatttatagtaaaacaaattaaaatggtaaggtaaatttccacaacaaaacttggtaaaaatcttaaaaaaaaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagttttgatctgcccgttcaaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaata

SEQ ID NO: 7 - DNA, 1627 bp, Arabidopsis thaliana
  misc_feature: Encoded by SEQ ID NO: 6
  misc_feature (1)..(1627): Ceres CDNA ID no. 13593066
  misc_feature (1)..(1627): Sequence of endogenous gene to Ceres PROMOTER  YP0388
aaagcttccatggctaatcttgtttaagcttctcttcttcttctctctcctgtgtctcgttcactagttttttttcgggggagagtgatggagtgtgtttgttgaatagttttgacgatcacatggctgagatttgttacgagaacgagactatgatgattgaaacgacggcgacggtggtgaagaaggcaacgacgacaacgaggagacgagaacggagctcgtctcaagcagcgagaagaaggagaatggagatccggaggtttaagtttgtttccggcgaacaagaacctgtcttcgtcgacggtgacttacagaggcggaggagaagagaatccaccgtcgcagcctccacctccaccgtgttttacgaaacggcgaaggaagttgtcgtcctatgcgagtctcttagttcaacggttgtggcattgcctgatcctgaagcttatcctaaatacggcgtcgcttcagtctgtggaagaagacgtgaaatggaagacgccgtcgctgtgcatccgtttttttcccgtcatcagacggaatattcatccaccggatttcactattgcggcgtttacgatggccatggctgttcccatgtagcgatgaaatgtagagaaagactacacgagctagtccgtgaagagtttgaagctgatgctgactgggaaaagtcaatggcgcgtagcttcacgcgcatggacatggaggttgttgcgttgaacgccgatggtgcggcaaaatgccggtgcgagcttcagaggccggactgcgacgcggtgggatccactgcggttgtgtctgtccttacgccggagaaaatcatcgtggcgaattgcggtgactcacgtgccgttctctgtcgtaacggcaaagccattgctttatcctccgatcataagccagaccgtccggacgagctagaccggattcaagcagcgggtggtcgtgttatctactgggatggcccacgtgtccttggagtacttgcaatgtcacgagccattggagataattacttgaagccgtatgtaatcagcagaccggaggtaaccgtgacggaccgggccaacggagacgattttcttattctcgcaagtgacggtctttgggacgttgtttcaaacgaaactgcatgtagcgtcgttcgaatgtgtttgagaggaaaagtcaatggtcaagtatcatcatcaccggaaagggaaatgacaggtgtcggcgccgggaatgtggtggttggaggaggagatttgccagataaagcgtgtgaggaggcgtcgctgttgctgacgaggcttgcgttggctagacaaagttcggacaacgtaagtgttgtggtggttgatctacgacgagacacgtagttgtatttgtctctctcgtaatgtttgttgttttttgtcctgagtcatcgacttttgggctttttcttttaaccttttttgctcttcggtgtaagacaacgaagggtttttaatttagcttgactatgggttatgtcagtcactgtgttgaatcgcggtttagatctacaaagattttcaccagtagtgaaaatggtaaaaagccgtgaaatgtgaaagacttgagttcaatttaattttaaatttaatagaatcagttgatc

SEQ ID NO: 8 - protein, 413 aa, Arabidopsis thaliana
  misc_feature (1)..(413): Ceres CDNA ID no. 13593066
  misc_feature (1)..(413): Sequence of endogenous gene to Ceres PROMOTER  YP0388
MAEICYENETMMIETTATVVKKATTTTRRRERSSSQAARRRRMEIRRFKFVSGEQEPVFVDGDLQRRRRRESTVAASTSTVFYETAKEVVVLCESLSSTVVALPDPEAYPKYGVASVCGRRREMEDAVAVHPFFSRHQTEYSSTGFHYCGVYDGHGCSHVAMKCRERLHELVREEFEADADWEKSMARSFTRMDMEVVALNADGAAKCRCELQRPDCDAVGSTAVVSVLTPEKIIVANCGDSRAVLCRNGKAIALSSDHKPDRPDELDRIQAAGGRVIYWDGPRVLGVLAMSRAIGDNYLKPYVISRPEVTVTDRANGDDFLILASDGLWDVVSNETACSVVRMCLRGKVNGQVSSSPEREMTGVGAGNVVVGGGDLPDKACEEASLLLTRLALARQSSDNVSVVVVDLRRDT

SEQ ID NO: 9 - DNA, 950 bp, Arabidopsis thaliana
  misc_feature (1)..(950): Ceres PROMOTER  YP0385
aaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccacc

SEQ ID NO: 10 - DNA, 2310 bp, Arabidopsis thaliana
  misc_feature: Encoded by SEQ ID NO: 9
  misc_feature (1)..(2310): Ceres CDNA ID no. 12658348
  misc_feature (1)..(2310): Sequence of endogenous gene to Ceres PROMOTER  YP0385
aaaccaactctctcttctctcttctctcctctcttctacaagaagaaaaaaaacagagcctttacacatctcaaaatcgaacttactttaaccaccaaatactgattgaacacacttgaaaaatggcttctttcacggcaacggctgcggtttctgggagatggcttggtggcaatcatactcagccgccattatcgtcttctcaaagctccgacttgagttattgtagctccttacctatggccagtcgtgtcacacgtaagctcaatgtttcatctgcgcttcacactcctccagctcttcatttccctaagcaatcatcaaactctcccgccattgttgttaagcccaaagccaaagaatccaacactaaacagatgaatttgttccagagagcggcggcggcagcgttggacgcggcggagggtttccttgtcagccacgagaagctacacccgcttcctaaaacggctgatcctagtgttcagatcgccggaaattttgctccggtgaatgaacagcccgtccggcgtaatcttccggtggtcggaaaacttcccgattccatcaaaggagtgtatgtgcgcaacggagctaacccacttcacgagccggtgacaggtcaccacttcttcgacggagacggtatggttcacgccgtcaaattcgaacacggttcagctagctacgcttgccggtttactcagactaaccggtttgttcaggaacgtcaattgggtcgaccggttttccccaaagccatcggtgagcttcacggccacaccggtattgcccgactcatgctattctacgccagagctgcagccggtatagtcgacccggcacacggaaccggtgtagctaacgccggtttggtctatttcaatggccggttattggctatgtcggaggatgatttaccttaccaagttcagatcactcccaatggagatttaaaaaccgttggtcggttcgattttgatggacaattagaatccacaatgattgcccacccgaaagtcgacccggaatccggtgaactcttcgctttaagctacgacgtcgtttcaaagccttacctaaaatacttccgattctcaccggacggaactaaatcaccggacgtcgagattcagcttgatcagccaacgatgatgcacgatttcgcgattacagagaacttcgtcgtcgtacctgaccagcaagtcgttttcaagctgccggagatgatccgcggtgggtctccggtggtttacgacaagaacaaggtcgcaagattcgggattttagacaaatacgccgaagattcatcgaacattaagtggattgatgctccagattgcttctgcttccatctctggaacgcttgggaagagccagaaacagatgaagtcgtcgtgatagggtcctgtatgactccaccagactcaattttcaacgagtctgacgagaatctcaagagtgtcctgtctgaaatccgcctgaatctcaaaaccggtgaatcaactcgccgtccgatcatctccaacgaagatcaacaagtcaacctcgaagcagggatggtcaacagaaacatgctcggccgtaaaaccaaattcgcttacttggctttagccgagccgtggcctaaagtctcaggattcgctaaagttgatctcactactggagaagttaagaaacatctttacggcgataaccgttacggaggagagcctctgtttctccccggagaaggaggagaggaagacgaaggatacatcctctgtttcgttcacgacgagaagacatggaaatcggagttacagatagttaacgccgttagcttagaggttgaagcaacggttaaacttccgtcaagggttccgtacggatttcacggtacattcatcggagccgatgatttggcgaagcaggtcgtgtgagttcttatgtgtaaatacgcacaaaatacatatacgtgatgaagaagcttctagaaggaaaagagagagcgagatttaccagtgggatgctctgcatatacgtccccggaatctgctcctctgtttttttttttttgctctgtttcttgtttgttgtttcttttggggtgcggtttgctagttcccttttttttggggtcaatctagaaatctgaaagattttgagggaccagcttgtagcttttgggctgtagggtagcctagccgttcgagctcagctggtttctgttattctttcacttattgttcatcgtaatgagaagtatataaaatattaaacaacaaagatatgtttgtatatgtgcatgaattaaggaacatttttttt

SEQ ID NO: 11 - protein, 599 aa, Arabidopsis thaliana
  misc_feature (1)..(599): Ceres CDNA ID no. 12658348
  misc_feature (1)..(599): Sequence of endogenous gene to Ceres PROMOTER  YP0385
MASFTATAAVSGRWLGGNHTQPPLSSSQSSDLSYCSSLPMASRVTRKLNVSSALHTPPALHFPKQSSNSPAIVVKPKAKESNTKQMNLFQRAAAAALDAAEGFLVSHEKLHPLPKTADPSVQIAGNFAPVNEQPVRRNLPVVGKLPDSIKGVYVRNGANPLHEPVTGHHFFDGDGMVHAVKFEHGSASYACRFTQTNRFVQERQLGRPVFPKAIGELHGHTGIARLMLFYARAAAGIVDPAHGTGVANAGLVYFNGRLLAMSEDDLPYQVQITPNGDLKTVGRFDFDGQLESTMIAHPKVDPESGELFALSYDVVSKPYLKYFRFSPDGTKSPDVEIQLDQPTMMHDFAITENFVVVPDQQVVFKLPEMIRGGSPVVYDKNKVARFGILDKYAEDSSNIKWIDAPDCFCFHLWNAWEEPETDEVVVIGSCMTPPDSIFNESDENLKSVLSEIRLNLKTGESTRRPIISNEDQQVNLEAGMVNRNMLGRKTKFAYLALAEPWPKVSGFAKVDLTTGEVKKHLYGDNRYGGEPLFLPGEGGEEDEGYILCFVHDEKTWKSELQIVNAVSLEVEATVKLPSRVPYGFHGTFIGADDLAKQVV

SEQ ID NO: 12 - DNA, 950 bp, Arabidopsis thaliana
  misc_feature (1)..(950): Ceres PROMOTER  YP0384
ataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaa

SEQ ID NO: 13 - DNA, 1538 bp, Arabidopsis thaliana
  misc_feature: Encoded by SEQ ID NO: 12
  misc_feature (1)..(1538): Ceres CDNA ID no. 12730108
  misc_feature (1)..(1538): Sequence of endogenous gene to Ceres PROMOTER  YP0384
acaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaaccatggatccttcatttaggttcattaaagaggagtttcctgctggattcagtgattctccatcaccaccatcttcttcttcatacctttattcatcttccatggctgaagcagccataaatgatccaacaacattgagctatccacaaccattagaaggtctccatgaatcagggccacctccatttttgacaaagacatatgacttggtggaagattcaagaaccaatcatgtcgtgtcttggagcaaatccaataacagcttcattgtctgggatccacaggccttttctgtaactctccttcccagattcttcaagcacaataacttctccagttttgtccgccagctcaacacatatggtttcagaaaggtgaatccggatcggtgggagtttgcaaacgaagggtttcttagagggcaaaagcatctcctcaagaacataaggagaagaaaaacaagtaataatagtaatcaaatgcaacaacctcaaagttctgaacaacaatctctagacaatttttgcatagaagtgggtaggtacggtctagatggagagatggacagcctaaggcgagacaagcaagtgttgatgatggagctagtgagactaagacagcaacaacaaagcaccaaaatgtatctcacattgattgaagagaagctcaagaagaccgagtcaaaacaaaaacaaatgatgagcttccttgcccgcgcaatgcagaatccagattttattcagcagctagtagagcagaaggaaaagaggaaagagatcgaagaggcgatcagcaagaagagacaaagaccgatcgatcaaggaaaaagaaatgtggaagattatggtgatgaaagtggttatgggaatgatgttgcagcctcatcctcagcattgattggtatgagtcaggaatatacatatggaaacatgtctgaattcgagatgtcggagttggacaaacttgctatgcacattcaaggacttggagataattccagtgctagggaagaagtcttgaatgtggaaaaaggaaatgatgaggaagaagtagaagatcaacaacaagggtaccataaggagaacaatgagatttatggtgaaggtttttgggaagatttgttaaatgaaggtcaaaattttgattttgaaggagatcaagaaaatgttgatgtgttaattcagcaacttggttatttgggttctagttcacacactaattaagaagaaattgaaatgatgactactttaagcatttgaatcaacttgtttcctattagtaatttggctttgtttcaatcaagtgagtcgtggactaacttattgaatttgggggttaaatccgtttcttatttttggaaataaaattgctttttgttt

SEQ ID NO: 14 - protein, 406 aa, Arabidopsis thaliana
  misc_feature (1)..(406): Ceres CDNA ID no. 12730108
  misc_feature (1)..(406): Sequence of endogenous gene to Ceres PROMOTER  YP0384
MDPSFRFIKEEFPAGFSDSPSPPSSSSYLYSSSMAEAAINDPTTLSYPQPLEGLHESGPPPFLTKTYDLVEDSRTNHVVSWSKSNNSFIVWDPQAFSVTLLPRFFKHNNFSSFVRQLNTYGFRKVNPDRWEFANEGFLRGQKHLLKNIRRRKTSNNSNQMQQPQSSEQQSLDNFCIEVGRYGLDGEMDSLRRDKQVLMMELVRLRQQQQSTKMYLTLIEEKLKKTESKQKQMMSFLARAMQNPDFIQQLVEQKEKRKEIEEAISKKRQRPIDQGKRNVEDYGDESGYGNDVAASSSALIGMSQEYTYGNMSEFEMSELDKLAMHIQGLGDNSSAREEVLNVEKGNDEEEVEDQQQGYHKENNEIYGEGFWEDLLNEGQNFDFEGDQENVDVLIQQLGYLGSSSHTN

SEQ ID NO: 15 - DNA, 950 bp, Arabidopsis thaliana
  misc_feature (1)..(950): Ceres PROMOTER  YP0382
ttttttaaaattcgttggaacttggaagggattttaaatattattttgttttccttcatttttataggttaataattgtcaaagatacaactcgatggaccaaaataaaataataaaattcgtcgaatttggtaaagcaaaacggtcgaggatagctaatatttatgcgaaacccgttgtcaaagcagatgttcagcgtcacgcacatgccgcaaaaagaatatacatcaacctcttttgaacttcacgccgttttttaggcccacaataatgctacgtcgtcttctgggttcaccctcgttttttttttaaacttctaaccgataaaataaatggtccactatttcttttcttctctgtgtattgtcgtcagagatggtttaaaagttgaaccgaactataacgattctcttaaaatctgaaaaccaaactgaccgattttcttaactgaaaaaaaaaaaaaaaaaaactgaatttaggccaacttgttgtaatatcacaaagaaaattctacaatttaattcatttaaaaataaagaaaaatttaggtaacaatttaactaagtggtctatctaaatcttgcaaattctttgactttgaccaaacacaacttaagttgacagccgtctcctctctgttgtttccgtgttattaccgaaatatcagaggaaagtccactaaaccccaaatattaaaaatagaaacattactttctttacaaaaggaatctaaattgatccctttcattcgtttcactcgtttcatatagttgtatgtatatatgcgtatgcatcaaaaagtctctttatatcctcagagtcacccaatcttatctctctctccttcgtcctcaagaaaagtaattctctgtttgtgtagttttctttaccggtgaattttctcttcgttttgtgcttcaaacgtcacccaaatcaccaagatcgatcaa

SEQ ID NO: 16 - DNA, 1720 bp, Arabidopsis thaliana
  misc_feature: Encoded by SEQ ID NO: 15
  misc_feature (1)..(1720): Ceres CDNA ID no. 12735575
  misc_feature (1)..(1720): Sequence of endogenous gene to Ceres PROMOTER  YP0382
agagtcacccaatcttatctctctctccttcgtcctcaagaaaagtaattctctgtttgtgtagttttctttaccggtgaattttctcttcgttttgtgcttcaaacgtcacccaaatcaccaagatcgatcaaaatcgaaacttaacgtttcagaagatggtgcagtaccagagattaatcatccaccatggaagaaaagaagataagtttagagtttcttcagcagaggaaagtggtggaggtggttgttgctactccaagagagctaaacaaaagtttcgttgtcttctctttctctctatcctctcttgctgtttcgtcttgtctccttattacctcttcggcttctctactctctccctcctagattcgtttcgcagagaaatcgaaggtcttagctcttatgagccagttattacccctctgtgctcagaaatctccaatggaaccatttgttgtgacagaaccggtttgagatctgatatttgtgtaatgaaaggtgatgttcgaacaaactctgcttcttcctcaatcttcctcttcacctcctccaccaataacaacacaaaaccggaaaagatcaaaccttacactagaaaatgggagactagtgtgatggacaccgttcaagaactcaacctcatcaccaaagattccaacaaatcttcagatcgtgtatgcgatgtgtaccatgatgttcctgctgtgttcttctccactggtggatacaccggtaacgtataccacgagtttaacgacgggattatccctttgtttataacttcacagcattacaacaaaaaagttgtgtttgtgatcgtcgagtatcatgactggtgggagatgaagtatggagatgtcgtttcgcagctctcggattatcctctggttgatttcaatggagatacgagaacacattgtttcaaagaagcaaccgttggattacgtattcacgacgagttaactgtgaattcttctttggtcattgggaatcaaaccattgttgacttcagaaacgttttggataggggttactcgcatcgtatccaaagcttgactcaggaggaaacagaggcgaacgtgaccgcactcgatttcaagaagaagccaaaactggtgattctttcaagaaacgggtcatcaagggcgatattaaacgagaatcttctcgtggagctagcagagaaaacagggttcaatgtggaggttctaagaccacaaaagacaacggaaatggccaagatttatcgttcgttgaacacgagcgatgtaatgatcggtgtacatggagcagcaatgactcatttccttttcttgaaaccgaaaaccgttttcattcagatcatcccattagggacggactgggcggcagagacatattatggagaaccggcgaagaagctaggattgaagtacgttggttacaagattgcgccgaaagagagctctttgtatgaagaatatgggaaagatgaccctgtaatccgagatccggatagtctaaacgacaaaggatgggaatatacgaagaaaatctatctacaaggacagaacgtgaagcttgacttgagaagattcagagaaacgttaactcgttcgtatgatttctccattagaaggagatttagagaagattacttgttacatagagaagattaagaatcgtgtgatattttttttgtaaagttttgaatgacaattaaatttatttattttat

SEQ ID NO: 17 - protein, 500 aa, Arabidopsis thaliana
  misc_feature (1)..(500): Ceres CDNA ID no. 12735575
  misc_feature (1)..(500): Sequence of endogenous gene to Ceres PROMOTER  YP0382
MVQYQRLIIHHGRKEDKFRVSSAEESGGGGCCYSKRAKQKFRCLLFLSILSCCFVLSPYYLFGFSTLSLLDSFRREIEGLSSYEPVITPLCSEISNGTICCDRTGLRSDICVMKGDVRTNSASSSIFLFTSSTNNNTKPEKIKPYTRKWETSVMDTVQELNLITKDSNKSSDRVCDVYHDVPAVFFSTGGYTGNVYHEFNDGIIPLFITSQHYNKKVVFVIVEYHDWWEMKYGDVVSQLSDYPLVDFNGDTRTHCFKEATVGLRIHDELTVNSSLVIGNQTIVDFRNVLDRGYSHRIQSLTQEETEANVTALDFKKKPKLVILSRNGSSRAILNENLLVELAEKTGFNVEVLRPQKTTEMAKIYRSLNTSDVMIGVHGAAMTHFLFLKPKTVFIQIIPLGTDWAAETYYGEPAKKLGLKYVGYKIAPKESSLYEEYGKDDPVIRDPDSLNDKGWEYTKKIYLQGQNVKLDLRRFRETLTRSYDFSIRRRFREDYLLHRED

SEQ ID NO: 18 - DNA, 950 bp, Arabidopsis thaliana
  misc_feature (1)..(950): Ceres PROMOTER  YP0381
tcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctcc

SEQ ID NO: 19 - DNA, 1193 bp, Arabidopsis thaliana
  misc_feature: Encoded by SEQ ID NO: 18
  misc_feature (1)..(1193): Ceres CDNA ID no. 12736859
  misc_feature (1)..(1193): Sequence of endogenous gene to Ceres PROMOTER  YP0381
aaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggctcatgtcgaagaaacagagattgtctgaagaagatggagaggtagagattgagttagacttaggtctatctctaaatggaagatttggtgttgacccacttgcgaaaacaaggcttatgaggtctacgtcggttcttgatttggtggtcaacgataggtcagggctgagtaggacttgttcgttacccgtggagacggaggaagagtggaggaagaggaaggagttgcagagtttgaggaggcttgaggctaagagaaagagatcagagaagcagaggaaacataaagcttgtggtggtgaagagaaggttgtggaagaaggatctattggttcttctggtagtggttcctctggtttgtctgaagttgatactcttcttcctcctgttcaagcaacaacgaacaagtccgtggaaacaagcccttcaagtgcccaatctcagcccgagaatttgggcaaagaagcgagccaaaacattatagaggacatgccattcgtgtcaacaacaggcgatggaccgaacgggaaaaagattaatgggtttctgtatcggtaccgcaaaggtgaggaggtgaggattgtctgtgtgtgtcatggaagcttcctctcaccggcagaattcgttaagcatgctggtggtggtgacgttgcacatcccttaaagcacatcgttgtaaatccatctcccttcttgtgaccctttgggtctcttttgaggggtttgttgtatcggaaccatgttacaaatcctcattatctccgaggtgtataaacataaatttatcgaactcgcaattttcagattttgtacttaaaagaatggtttcattcgttgagattaattttagacctttttcttgtac

SEQ ID NO: 20 - protein, 230 aa, Arabidopsis thaliana
  misc_feature (1)..(230): Ceres CDNA ID no. 12736859
  misc_feature (1)..(230): Sequence of endogenous gene to Ceres PROMOTER  YP0381
MSKKQRLSEEDGEVEIELDLGLSLNGRFGVDPLAKTRLMRSTSVLDLVVNDRSGLSRTCSLPVETEEEWRKRKELQSLRRLEAKRKRSEKQRKHKACGGEEKVVEEGSIGSGSGSSGLSEVDTLLPPVQATTNKSVETSPSSAQSQPENLGKEASQNIIEDMPFVSTTGDGPNGKKINGFLYRYRKGEEVRIVCVCHGSFLSPAEFVKHAGGGDVAHPLKHIVVNPSPFL

SEQ ID NO: 21 - DNA, 950 bp, Arabidopsis thaliana
  misc_feature (1)..(950): Ceres PROMOTER  YP0380
tttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcga

SEQ ID NO: 22 - DNA, 995 bp, Arabidopsis thaliana
  misc_feature: Encoded by SEQ ID NO: 21
  misc_feature (1)..(995): Ceres CDNA ID no. 12462179
  misc_feature (1)..(995): Sequence of endogenous gene to Ceres PROMOTER  YP0380
aatgtgtacgtcttttgcataagaagaaacagagagcattatcaattattaacaattacacaagacagcgagattgtaaaagagtaagagagagagaatggcaggagaggcagaggctttggccacgacggcaccgttagctccggtcaccagtcagcgaaaagtacggaacgatttggaggaaacattaccaaaaccatacatggcaagagcattagcagctccagatacagagcatccgaatggaacagaaggtcacgatagcaaaggaatgagtgttatgcaacaacatgttgctttcttcgaccaaaacgacgatggaatcgtctatccttgggagacttataagggatttcgtgaccttggtttcaacccaatttcctctatcttttggaccttactcataaacttagcgttcagctacgttacacttccgagttgggtgccatcaccattattgccggtttatatcgacaacatacacaaagccaagcatgggagtgattcgagcacctatgacaccgaaggaaggtatgtcccagttaacctcgagaacatatttagcaaatacgcgctaacggttaaagataagttatcatttaaagaggtttggaatgtaaccgagggaaatcgaatggcaatcgatccttttggatggctttcaaacaaagttgaatggatactactctatattcttgctaaggacgaagatggtttcctatctaaagaagctgtgagaggttgctttgatggaagtttatttgaacaaattgccaaagagagggccaattctcgcaaacaagactaagaatgtgtgtgtttggttagcgaataaagctttttgaagaaaagcattgtgtaatttagcttctttcgtcttgttattcagtttggggatttgtataattaatgtgtttgtaaactatgtttcaaagttatataaataagagaagatgttacaaaaaaaaaaaaaagactaataagaagaatttggt

SEQ ID NO: 23 - protein, 236 aa, Arabidopsis thaliana
  misc_feature (1)..(236): Ceres CDNA ID no. 12462179
  misc_feature (1)..(236): Sequence of endogenous gene to Ceres PROMOTER  YP0380
MAGEAEALATTAPLAPVTSQRKVRNDLEETLPKPYMARALAAPDTEHPNGTEGHDSKGMSVMQQHVAFFDQNDDGIVYPWETYKGFRDLGFNPISSIFWTLLINLAFSYVTLPSWVPSPLLPVYIDNIHKAKHGSDSSTYDTEGRYVPVNLENIFSKYALTVKDKLSFKEVWNVTEGNRMAIDPFGWLSNKVEWILLYILAKDEDGFLSKEAVRGCFDGSLFEQIAKERANSRKQD

SEQ ID NO: 24 - DNA, 1071 bp, Arabidopsis thaliana
  misc_feature (1)..(1071): Ceres PROMOTER  YP00374
agaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatgtatgtttttgttccctattatatcttctagcttctttcttcctcttcttccttaaaaattcatcctccaaaacattctatcatcaacgaaacatttcatattaaattaaataataatcg

SEQ ID NO: 25 - DNA, 1685 bp, Arabidopsis thaliana
  misc_feature: Encoded by SEQ ID NO: 24
  misc_feature (1)..(1685): Ceres CDNA ID no. 12370888
  misc_feature (1)..(1685): Sequence of endogenous gene to Ceres PROMOTER  YP00374
gtatgtttttgttccctattatatcttctagcttctttcttcctcttcttccttaaaaattcatcctccaaaacattctatcatcaacgaaacatttcatattaaattaaataataatcgatggctgaaatttggttcttggttgtaccaatcctcatcttatgcttgcttttggtaagagtgattgtttcaaagaagaaaaagaacagtagaggtaagcttcctcctggttccatgggatggccttacttaggagagactctacaactctattcacaaaaccccaatgttttcttcacctccaagcaaaagagatatggagagatattcaaaacccgaatcctcggctatccatgcgtgatgttggctagccctgaggctgcgaggtttgtacttgtgactcatgcccatatgttcaaaccaacttatccgagaagcaaagagaagctgataggaccctctgcactctttttccaccaaggagattatcattcccatataaggaaacttgttcaatcctctttctaccctgaaaccatccgtaaactcatccctgatatcgagcacattgccctttcttccttacaatcttgggccaatatgccgattgtctccacctaccaggagatgaagaagttcgcctttgatgtgggtattctagccatatttggacatttggagagttcttacaaagagatcttgaaacataactacaatattgtggacaaaggctacaactctttccccatgagtctccccggaacatcttatcacaaagctctcatggcgagaaagcagctaaagacgatagtaagcgagattatatgcgaaagaagagagaaaagggccttgcaaacggactttcttggtcatctactcaacttcaagaacgaaaaaggtcgtgtgctaacccaagaacagattgcagacaacatcatcggagtccttttcgccgcacaggacacgacagctagttgcttaacttggattcttaagtacttacatgatgatcagaaacttctagaagctgttaaggctgagcaaaaggctatatatgaagaaaacagtagagagaagaaacctttaacatggagacaaacgaggaatatgccactgacacataaggttatagttgaaagcttgaggatggcaagcatcatatccttcacattcagagaagcagtggttgatgttgaatataagggatatttgatacctaagggatggaaagtgatgccactgtttcggaatattcatcacaatccgaaatatttttcaaaccctgaggttttcgacccatctagattcgaggtaaatccgaagccgaatacattcatgccttttggaagtggagttcatgcttgtcccgggaacgaactcgccaagttacaaattcttatatttctccaccatttagtttccaatttccgatgggaagtgaagggaggagagaaaggaatacagtacagtccatttccaatacctcaaaacggtcttcccgctacatttcgtcgacattctctttagttccttaaacctttgtagtaatctttgttgtagttagccaaatctaatccaaattcgatataaaaaatcccctttctatttttttttaaaatcattgttgtagtcttgagggggtttaacatgtaacaactatgatgaagtaaaatgtcgattccggt

SEQ ID NO: 26 - protein, 468 aa, Arabidopsis thaliana
  misc_feature (1)..(468): Ceres CDNA ID no. 12370888
  misc_feature (1)..(468): Sequence of endogenous gene to Ceres PROMOTER  YP00374
MAEIWFLVVPILILCLLLVRVIVSKKKKNSRGKLPPGSMGWPYLGETLQLYSQNPNVFFTSKQKRYGEIFKTRILGYPCVMLASPEAARFVLVTHAHMFKPTYPRSKEKLIGPSALFFHQGDYHSHIRKLVQSSFYPETIRKLIPDIEHIALSSLQSWANMPIVSTYQEMKKFAFDVGILAIFGHLESSYKEILKHNYNIVDKGYNSFPMSLPGTSYHKALMARKQLKTIVSEIICERREKRALQTDFLGHLLNFKNEKGRVLTQEQIADNIIGVLFAAQDTTASCLTWILKYLHDDQKLLEAVKAEQKAIYEENSREKKPLTWRQTRNMPLTHKVIVESLRMASIISFTFREAVVDVEYKGYLIPKGWKVMPLFRNIHHNPKYFSNPEVFDPSRFEVNPKPNTFMPFGSGVHACPGNELAKLQILIFLHHLVSNFRWEVKGGEKGIQYSPFPIPQNGLPATFRRHSL

SEQ ID NO: 27 - DNA, 950 bp, Arabidopsis thaliana
  misc_feature (1)..(950): Ceres PROMOTER  YP0371
gattctgcgaagacaggagaagccatacctttcaatctaagccgtcaacttgttcccttacgtgggatcctattatacaatccaacggttctaaatgagccacgccttccagatctaacacagtcatgctttctacagtctgcaccccttttttttttagtgttttatctacattttttcctttgtgtttaattttgtgccaacatctataacttacccctataaaaatattcaattatcacagaatacccacaatcgaaaacaaaatttaccggaataatttaattaaagctggactataatgacaattccgaaactatcaaggaataaattaaagaaactaaaaaactaaagggcattagagtaaagaagcggcaacatcagaattaaaaaactgccgaaaaaccaacctagtagccgtttatatgacaacacgtacgcaaagtctcggtaatgactcatcagttttcatgtgcaaacatattacccccatgaaataaaaaagcagagaagcgatcaaaaaaatcttcattaaaagaaccctaaatctctcatatccgccgccgtctttgcctcattttcaacaccggtgatgacgtgtaaatagatctggttttcacggttctcactactctctgtgatttttcagactattgaatcgttaggaccaaaacaagtacaaagaaactgcagaagaaaagatttgagagagatatcttacgaaacaaggtatatatttctcttgttaaatctttgaaaatactttcaaagtttcggttggattctcgaataagttaggttaaatagtcaatatagaattatagataaatcgataccttttgtttgttatcattcaatttttattgttgttacgattagtaacaacgttttagatcttgatctatatattaataatactaatactttgtttttttttgttttttttttaa

SEQ ID NO: 28 - DNA, 2828 bp, Arabidopsis thaliana
  misc_feature: Encoded by SEQ ID NO: 27
  misc_feature (1)..(2828): Ceres CDNA ID no. 12657397
  misc_feature (1)..(2828): Sequence of endogenous gene to Ceres PROMOTER  YP0371
agcgatcaaaaaaatcttcattaaaagaaccctaaatctctcatatccgccgccgtctttgcctcattttcaacaccggtgatgacgtgtaaatagatctggttttcacggttctcactactctctgtgatttttcagactattgaatcgttaggaccaaaacaagtacaaagaaactgcagaagaaaagatttgagagagatatcttacgaaacaagcaaacagatgttgttgtcggcgcttggcgtcggagttggagtaggtgtgggtttaggcttggcttctggtcaagccgtcggaaaatgggccggcgggaactcgtcgtcaaataacgccgtcacggcggataagatggagaaggagatactccgtcaagttgttgacggcagagagagtaaaattactttcgatgagtttccttattatctcagtgaacaaacacgagtgcttctaacaagtgcagcttatgtccatttgaagcacttcgatgcttcaaaatatacgagaaacttgtctccagctagccgagccattctcttgtccggccctgccgagctttaccaacaaatgctagccaaagccctagctcatttcttcgatgccaagttacttcttctagacgtcaacgattttgcactcaagatacagagcaaatacggcagtggaaatacagaatcatcgtcattcaagagatctccctcagaatctgctttagagcaactatcaggactgtttagttccttctccatccttcctcagagagaagagtcaaaagctggtggtaccttgaggaggcaaagcagtggtgtggatatcaaatcaagctcaatggaaggctctagtaatcctccaaagcttcgtcgaaactcttcagcagcagctaatattagcaaccttgcatcttcctcaaatcaagtttcagcgcctttgaaacgaagtagcagttggtcattcgatgaaaagcttctcgtccaatctttatataaggtcttggcctatgtctccaaggcgaatccgattgtgttatatcttcgagacgtcgagaactttctgttccgctcacagagaacttacaacttgttccagaagcttctccagaaactcagtggaccggtcctcattctcggttcaagaattgtggacttgtcaagcgaagacgctcaagaaattgatgagaagctctctgctgttttcccttataatatcgacataagacctcctgaggatgagactcatctagtgagctggaaatcgcagcttgaacgcgacatgaacatgatccaaactcaggacaataggaaccatatcatggaagttttgtcggagaatgatcttatatgcgatgaccttgaatccatctcttttgaggacacgaaggttttaagcaattacattgaagagatcgttgtctctgctctttcctatcatctgatgaacaacaaagatcctgagtacagaaacggaaaactggtgatatcttctataagtttgtcgcatggattcagtctcttcagagaaggcaaagctggcggtcgtgagaagctgaagcaaaaaactaaggaggaatcatccaaggaagtaaaagctgaatcaatcaagccggagacaaaaacagagagtgtcaccaccgtaagcagcaaggaagaaccagagaaagaagctaaagctgagaaagttaccccaaaagctccggaagttgcaccggataacgagtttgagaaacggataagaccggaagtaatcccagcagaagaaattaacgtcacattcaaagacattggtgcacttgacgagataaaagagtcactacaagaacttgtaatgcttcctctccgtaggccagacctcttcacaggaggtctcttgaagccctgcagaggaatcttactcttcggtccaccgggtacaggtaaaacaatgctagctaaagccattgccaaagaggcaggagcgagtttcataaacgtttcgatgtcaacaataacttcgaaatggtttggagaagacgagaagaatgttagggctttgtttactctagcttcgaaggtgtcaccaaccataatatttgtggatgaagttgatagtatgttgggacagagaacaagagttggagaacatgaagctatgagaaagatcaagaatgagtttatgagtcattgggatgggttaatgactaaacctggtgaacgtatcttagtccttgctgctactaatcggcctttcgatcttgatgaagccattatcagacgattcgaacgaaggatcatggtgggactaccggctgtagagaacagagaaaagattctaagaacattgttggcgaaggagaaagtagatgaaaacttggattacaaggaactagcaatgatgacagaaggatacacaggaagtgatcttaagaatctgtgcacaaccgctgcgtataggccggtgagagaacttatacagcaagagaggatcaaagacacagagaagaagaagcagagagagcctacaaaagcaggtgaagaagatgaaggaaaagaagagagagttataacacttcgtccgttgaacagacaagactttaaagaagccaagaatcaggtggcggcgagttttgcggctgagggagcgggaatgggagagttgaagcagtggaatgaattgtatggagaaggaggatcgaggaagaaagaacaactcacttacttcttgtaatgatgatgatgaatcatgatgctggtaatggattatgaaatttggtaatgtaatagtatggtgaatttttgtttccatggttaataagagaataagaatatgatgatattgctaaaagtttgacccgt

SEQ ID NO: 29 - protein, 824 aa, Arabidopsis thaliana
  misc_feature (1)..(824): Ceres CDNA ID no. 12657397
  misc_feature (1)..(824): Sequence of endogenous gene to Ceres PROMOTER  YP0371
MLLSALGVGVGVGVGLGLASGQAVGKWAGGNSSSNNAVTADKMEKEILRQVVDGRESKITFDEFPYYLSEQTRVLLTSAAYVHLKHFDASKYTRNLSPASRAILLSGPAELYQQMLAKALAHFFDAKLLLLDVNDFALKIQSKYGSGNTESSSFKRSPSESALEQLSGLFSSFSILPQREESKAGGTLRRQSSGVDIKSSSMEGSSNPPKLRRNSSAAANISNLASSSNQVSAPLKRSSSWSFDEKLLVQSLYKVLAYVSKANPIVLYLRDVENFLFRSQRTYNLFQKLLQKLSGPVLILGSRIVDLSSEDAQEIDEKLSAVFPYNIDIRPPEDETHLVSWKSQLERDMNMIQTQDNRNHIMEVLSENDLICDDLESISFEDTKVLSNYIEEIVVSALSYHLMNNKDPEYRNGKLVISSISLSHGFSLFREGKAGGREKLKQKTKEESSKEVKAESIKPETKTESVTTVSSKEEPEKEAKAEKVTPKAPEVAPDNEFEKRIRPEVIPAEEINVTFKDIGALDEIKESLQELVMLPLRRPDLFTGGLLKPCRGILLFGPPGTGKTMLAKAIAKEAGASFINVSMSTITSKWFGEDEKNVRALFTLASKVSPTIIFVDEVDSMLGQRTRVGEHEAMRKIKNEFMSHWDGLMTKPGERILVLAATNRPFDLDEAIIRRFERRIMVGLPAVENREKILRTLLAKEKVDENLDYKELAMMTEGYTGSDLKNLCTTAAYRPVRELIQQERIKDTEKKKQREPTKAGEEDEGKEERVITLRPLNRQDFKEAKNQVAASFAAEGAGMGELKQWNELYGEGGSRKKEQLTYFL

SEQ ID NO: 30 - DNA, 1051 bp, Arabidopsis thaliana
  misc_feature (1)..(1051): Ceres PROMOTER  YP0356
tacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaagttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcacagctcctttctactaaaacccttttactataaattctacgtacacgtaccacttcttctcctcaaattcatcaaacccatttctattccaactcccaaaa

SEQ ID NO: 31 - DNA, 1521 bp, Arabidopsis thaliana
  misc_feature: Encoded by SEQ ID NO: 30
  misc_feature (1)..(1521): Ceres CDNA ID no. 12394809
  misc_feature (1)..(1521): Sequence of endogenous gene to Ceres PROMOTER  YP0356
agctcctttctactaaaacccttttactataaattctacgtacacgtaccacttcttctcctcaaattcatcaaacccatttctattccaactcccaaaaatggcgattcgtcttcctctgatctgtcttcttggttcattcatggtagtggcgattgcggctgatttaacaccggagcgttattggagcactgctttaccaaacactcccattcccaactctctccataatcttttgactttcgattttaccgacgagaaaagtaccaacgtccaagtaggtaaaggcggagtaaacgttaacacccataaaggtaaaaccggtagcggaaccgccgtgaacgttggaaagggaggtgtacgcgtggacacaggcaagggcaagcccggaggagggacacacgtgagcgttggcagcggaaaaggtcacggaggtggcgtcgcagtccacacgggtaaacccggtaaaagaaccgacgtaggagtcggtaaaggcggtgtgacggtgcacacgcgccacaagggaagaccgatttacgttggtgtgaaaccaggagcaaaccctttcgtgtataactatgcagcgaaggagactcagctccacgacgatcctaacgcggctctcttcttcttggagaaggacttggttcgcgggaaagaaatgaatgtccggtttaacgctgaggatggttacggaggcaaaactgcgttcttgccacgtggagaggctgaaacggtgccttttggatcggagaagttttcggagacgttgaaacgtttctcggtggaagctggttcggaagaagcggagatgatgaagaagaccattgaggagtgtgaagccagaaaagttagtggagaggagaagtattgtgcgacgtctttggagtcgatggtcgactttagtgtttcgaaacttggtaaatatcacgtcagggctgtttccactgaggtggctaagaagaacgcaccgatgcagaagtacaaaatcgcggcggctggggtaaagaagttgtctgacgataaatctgtggtgtgtcacaaacagaagtacccattcgcggtgttctactgccacaaggcgatgatgacgaccgtctacgcggttccgctcgagggagagaacgggatgcgagctaaagcagttgcggtatgccacaagaacacctcagcttggaacccaaaccacttggccttcaaagtcttaaaggtgaagccagggaccgttccggtctgccacttcctcccggagactcatgttgtgtggttcagctactagatagatctgttttctatcttattgtgggttatgtataattacgtttcagataatctatcttttgggatgttttggttatgaatatacatacatatacatatagtaatgcgtggtttccatataagagtgaaggcatctatatgtttttttttttattaacctacgtagctgtcttttgtggtctgtatcttgtggttttgcaaaaacctataataaaattagagctgaaatgttaccatttc

SEQ ID NO: 32 - protein, 392 aa, Arabidopsis thaliana
  misc_feature (1)..(392): Ceres CDNA ID no. 12394809
  misc_feature (1)..(392): Sequence of endogenous gene to Ceres PROMOTER  YP0356
MAIRLPLICLLGSFMVVAIAADLTPERYWSTALPNTPIPNSLHNLLTFDFTDEKSTNVQVGKGGVNVNTHKGKTGSGTAVNVGKGGVRVDTGKGKPGGGTHVSVGSGKGHGGGVAVHTGKPGKRTDVGVGKGGVTVHTRHKGRPIYVGVKPGANPFVYNYAAKETQLHDDPNAALFFLEKDLVRGKEMNVRFNAEDGYGGKTAFLPRGEAETVPFGSEKFSETLKRFSVEAGSEEAEMMKKTIEECEARKVSGEEKYCATSLESMVDFSVSKLGKYHVRAVSTEVAKKNAPMQKYKIAAAGVKKLSDDKSVVCHKQKYPFAVFYCHKAMMTTVYAVPLEGENGMRAKAVAVCHKNTSAWNPNHLAFKVLKVKPGTVPVCHFLPETHVVWFSY

SEQ ID NO: 33 - DNA, 966 bp, Arabidopsis thaliana
  misc_feature (1)..(966): Ceres PROMOTER  YP0337
acttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagtttttttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcaaagaaaacatcaaa

SEQ ID NO: 34 - DNA, 700 bp, Arabidopsis thaliana
  misc_feature: Encoded by SEQ ID NO: 33
  misc_feature (1)..(700): Ceres CDNA ID no. 12326510
  misc_feature (1)..(700): Sequence of endogenous gene to Ceres PROMOTER  YP0337
accacattaatttaaaacaaagaaaacatcaaaatggctgaaaaagtaaagtctggtcaagtttttaacctattatgcatattctcgatctttttcttcctctttgtgttatcagtgaatgtttcggctgatgtcgattctgagagagcggtgccatctgaagataaaacgacgactgtttggctaactaaaatcaaacggtccggtaaaaattattgggctaaagttagagagactttggatcgtggacagtcccacttctttcctccgaacacatattttaccggaaagaatgatgcgccgatgggagccggtgaaaatatgaaagaggcggcgacgaggagctttgagcatagcaaagcgacggtggaggaagctgctagatcagcggcagaagtggtgagtgatacggcggaagctgtgaaagaaaaggtgaagaggagcgtttccggtggagtgacgcagccgtcggagggatctgaggagctataaatacgcagttgttctaagcttatgggttttaattatttaaataattagtgtgtgtttgagatcaaaatgacacagttttgggggagtatatctccacatcatatgttgtttgcatcacatggtttctctgtatacaacgaccagatccacatcactcattctcgtccttctttttgtcatgaatacagaataatattttagattctac

SEQ ID NO: 35 - protein, 152 aa, Arabidopsis thaliana
  misc_feature (1)..(152): Ceres CDNA ID no. 12326510
  misc_feature (1)..(152): Sequence of endogenous gene to Ceres PROMOTER  YP0337
MAEKVKSGQVFNLLCIFSIFFFLFVLSVNVSADVDSERAVPSEDKTTTVWLTKIKRSGKNYWAKVRETLDRGQSHFFPPNTYFTGKNDAPMGAGENMKEAATRSFEHSKATVEEAARSAAEVVSDTAEAVKEKVKRSVSGGVTQPSEGSEEL

SEQ ID NO: 36 - DNA, 997 bp, Arabidopsis thaliana
  misc_feature (1)..(997): Ceres PROMOTER  YP0289
caaacaattactgctcaatgtatttgcgtatagagcatgtccaataccatgcctcatgatgtgagattgcgaggcggagtcagagaacgagttaaagtgacgacgttttttttgttttttttgggcatagtgtaaagtgatattaaaatttcatggttggcaggtgactgaaaataaaaatgtgtataggatgtgtttatatgctgacggaaaaatagttactcaactaatacagatctttataaagagtatataagtctatggttaatcatgaatggcaatatataagagtagatgagatttatgtttatattgaaacaagggaaagatatgtgtaattgaaacaatggcaaaatataagtcaaatcaaactggtttctgataatatatgtgttgaatcaatgtatatcttggtattcaaaaccaaaacaactacaccaatttctttaaaaaaccagttgatctaataactacattttaatactagtagctattagctgaatttcataatcaatttcttgcattaaaatttaaagtgggttttgcatttaaacttactcggtttgtattaatagactttcaaagattaaaagaaaactactgcattcagagaataaagctatcttactaaacactacttttaaagtttcttttttcacttattaatcttcttttacaaatggatctgtctctctgcatggcaaaatatcttacactaattttattttctttgtttgataacaaatttatcggctaagcatcacttaaatttaatacacgttatgaagacttaaaccacgtcacactataagaaccttacaggctgtcaaacacccttccctacccactcacatctctccacgtggcaatctttgatattgacaccttagccactacagctgtcacactcctctctcggtttcaaaacaacatctctggtataaataaatcaaaacctctcctatatctcttcaatctgatataactacccttctca

SEQ ID NO: 37 - DNA, 1218 bp, Arabidopsis thaliana
  misc_feature: Encoded by SEQ ID NO: 36
  misc_feature (1)..(1218): Ceres CDNA ID no. 12326995
  misc_feature (1)..(1218): Sequence of endogenous gene to Ceres PROMOTER  YP0289
aaatcaaaacctctcctatatctcttcaatctgatataactacccttctcaatggcttctaattaccgttttgccatcttcctcactctctttttcgccaccgctggtttctccgccgccgcgttggtcgaggagcagccgcttgttatgaaataccacaacggagttctgttgaaaggtaacatcacagtcaatctcgtatggtacgggaaattcacaccgatccaacggtccgtaatcgtcgatttcatccactcgctaaactccaaagacgttgcatcttccgccgcagttccttccgttgcttcgtggtggaagacgacggagaaatacaaaggtggctcttcaacactcgtcgtcgggaaacagcttctactcgagaactatcctctcggaaaatctctcaaaaatccttacctccgtgctttatccaccaaacttaacggcggtctccgttccataaccgtcgttctaacggcgaaagatgttaccgtcgaaagattctgtatgagccggtgcgggactcacggatcctccggttcgaatccccgtcgcgcagctaacggcgcggcttacgtatgggtcgggaactccgagacgcagtgccctggatattgcgcgtggccgtttcaccagccgatttacggaccacaaacgccgccgttagtagcgcctaacggtgacgttggagttgacggaatgattataaaccttgccacacttctagctaacaccgtgacgaatccgtttaataacggatattaccaaggcccaccaactgcaccgcttgaagctgtgtctgcttgtcctggtatattcgggtcaggttcttatccgggttacgcgggtcgggtacttgttgacaaaacaaccgggtctagttacaacgctcgtggactcgccggtaggaaatatctattgccggcgatgtgggatccgcagagttcgacgtgcaagactctggtttgatccaagggatgtgagtaagacacgtggcatagtagtgagagcgatgacgagatctagacggcatgtgtagtcaaaatcaagttgcacgcgagcgtgtgtataaaaaaatctttcgggtttgggtctcgggtttggattgtggatagggctctctctttgctttttgtcgttttgtaatgacgtgtaaaaactgtactcggaaatgtgaagaatgcatataaaataataaaaaatcattttgtttctact

SEQ ID NO: 38 - protein, 305 aa, Arabidopsis thaliana
  misc_feature (1)..(305): Ceres CDNA ID no. 12326995
  misc_feature (1)..(305): Sequence of endogenous gene to Ceres PROMOTER  YP0289
MASNYRFAIFLTLFFATAGFSAAALVEEQPLVMKYHNGVLLKGNITVNLVWYGKFTPIQRSVIVDFIHSLNSKDVASSAAVPSVASWWKTTEKYKGGSSTLVVGKQLLLENYPLGKSLKNPYLRALSTKLNGGLRSITVVLTAKDVTVERFCMSRCGTHGSSGSNPRRAANGAAYVWVGNSETQCPGYCAWPFHQPIYGPQTPPLVAPNGDVGVDGMIINLATLLANTVTNPFNNGYYQGPPTAPLEAVSACPGIFGSGSYPGYAGRVLVDKTTGSSYNARGLAGRKYLLPAMWDPQSSTCKTLV

SEQ ID NO: 39 - DNA, 950 bp, Arabidopsis thaliana
  misc_feature (1)..(950): Ceres PROMOTER  YP0286
atcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatatatatatctatgattaagtgtgtatgacataagaaactaaaatatttacctaaagtccagttactcatactgattttatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctct

SEQ ID NO: 40 - DNA, 837 bp, Arabidopsis thaliana
  misc_feature: Encoded by SEQ ID NO: 39
  misc_feature (1)..(837): Ceres CDNA ID no. 12669548
  misc_feature (1)..(837): Sequence of endogenous gene to Ceres PROMOTER  YP0286
atgacagaaatgccctcgtacatgatcgagaacccaaagttcgagccaaagaaacgacgttattactcttcttcgatgcttaccatcttcttaccgatcttcacatacattatgatctttcacgttttcgaagtatcactatcttcggtctttaaagacacaaaggtcttgttcttcatctccaatactctcatcctcataatagccgccgattatggttccttctctgataaagagagtcaagacttttacggtgaatacactgtcgcagcggcaacgatgcgaaaccgagctgataactactctccgattcccgtcttgacataccgagaaaacactaaagatggagaaatcaagaaccctaaagatgtcgaattcaggaaccctgaagaagaagacgaaccgatggtgaaagatatcatttgcgtttctcctcccgagaaaatagtacgagtggtgagtgagaagaaacagagagatgatgtagctatggaagaatacaaaccagttacagaacaaactcttgctagcgaagaagcttgcaacacaagaaaccatgtgaaccctaataaaccgtacgggcgaagtaaatcagataagccacggagaaagaggctcagcgtagatacagagacgaccaaacgtaaaagttatggtcgaaagaaatcagattgctcgagatggatggttattccggagaagtgggaatatgttaaagaagaatctgaagagttttcaaagttgtccaacgaggagttgaacaaacgagtcgaagaattcatccaacggttcaatagacagatcagatcacaatcaccgcgagtttcgtctacttga

SEQ ID NO: 41 - protein, 278 aa, Arabidopsis thaliana
  misc_feature (1)..(278): Ceres CDNA ID no. 12669548
  misc_feature (1)..(278): Sequence of endogenous gene to Ceres PROMOTER  YP0286
MTEMPSYMIENPKFEPKKRRYYSSSMLTIFLPIFTYIMIFHVFEVSLSSVFKDTKVLFFISNTLILIIAADYGSFSDKESQDFYGEYTVAAATMRNRADNYSPIPVLTYRENTKDGEIKNPKDVEFRNPEEEDEPMVKDIICVSPPEKIVRVVSEKKQRDDVAMEEYKPVTEQTLASEEACNTRNHVNPNKPYGRSKSDKPRRKRLSVDTETTKRKSYGRKKSDCSRWMVIPEKWEYVKEESEEFSKLSNEELNKRVEEFIQRFNRQIRSQSPRVSST

SEQ ID NO: 42 - DNA, 950 bp, Arabidopsis thaliana
  misc_feature (1)..(950): Ceres PROMOTER  YP0275
gcgtatgctttactttttaaaatgggcctatgctataattgaatgacaaggattaaacaactaataaaagtgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcactttaaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaatta

SEQ ID NO: 43 - DNA, 1747 bp, Arabidopsis thaliana
  misc_feature: Encoded by SEQ ID NO: 42
  misc_feature (1)..(1747): Ceres CDNA ID no. 12668112
  misc_feature (1)..(1747): Sequence of endogenous gene to Ceres PROMOTER  YP0275
ataaaaacttaattagtttttacagaagaaaagaaaacaatgagaggtaaatttctaagtttactgttgctcattactttggcctgcattggagtttccgccaagaagcattccacaaggcctagattaagaagaaatgatttcccacaagatttcgtttttggatctgctacttctgcttatcagtgtgaaggagctgcacatgaagatggtagaggtccaagtatctgggactccttctctgaaaaattcccagaaaagataatggatggtagtaatgggtccattgcagatgattcttacaatctttacaaggaagatgtgaatttgctgcatcaaattggcttcgatgcttaccgattttcgatctcatggtcacggattttgcctcgtgggactctaaagggaggaatcaaccaggctggaattgaatattataacaacttgattaatcaacttatatctaaaggagtgaagccatttgtcacactctttcactgggacttaccagatgcactcgaaaatgcttacggtggcctccttggagatgaatttgtgaacgatttccgagactatgcagaactttgtttccagaagtttggagatagagtgaagcagtggacgacactaaacgagccatatacaatggtacatgaaggttatataacaggtcaaaaggcacctggaagatgttccaatttctataaacctgattgcttaggtggcgatgcagccacggagccttacatcgtcggccataacctcctccttgctcatggagttgccgtaaaagtatatagagaaaagtaccaggcaactcagaaaggtgaaattggtattgccttaaacacagcatggcactacccttattcagattcatatgctgaccggttagctgcgactcgagcgactgccttcaccttcgactacttcatggagccaatcgtgtacggtagatatccaattgaaatggtcagccacgttaaagacggtcgtcttcctaccttcacaccagaagagtccgaaatgctcaaaggatcatatgatttcataggcgttaactattactcatctctttacgcaaaagacgtgccgtgtgcaactgaaaacatcaccatgaccaccgattcttgcgtcagcctcgtaggtgaacgaaatggagtgcctatcggtccagcggctggatcggattggcttttgatatatcccaagggtattcgtgatctcctactacatgcaaaattcagatacaatgatcccgtcttgtacattacagagaatggagtggatgaagcaaatattggcaaaatatttcttaacgacgatttgagaattgattactatgctcatcacctcaagatggttagcgatgctatctcgatcggggtgaatgtgaagggatatttcgcgtggtcattgatggataatttcgagtggtcggaaggatacacggtccggttcgggctagtgtttgtggactttgaagatggacgtaagaggtatctgaagaaatcagctaagtggtttaggagattgttgaagggagcgcatggtgggacgaatgagcaggtggctgttatttaataaaccacgagtcattggtcaatttagtctactgtttcttttgctctatgtacagaaagaaaataaactttccaaaataagaggtggctttgtttggactttggatgttactatatatattggtaattcttggcgtttgttagtttccaaaccaaacattaat

SEQ ID NO: 44 - protein, 514 aa, Arabidopsis thaliana
  misc_feature (1)..(514): Ceres CDNA ID no. 12668112
  misc_feature (1)..(514): Sequence of endogenous gene to Ceres PROMOTER  YP0275
MRGKFLSLLLLITLACIGVSAKKHSTRPRLRRNDFPQDFVFGSATSAYQCEGAAHEDGRGPSIWDSFSEKFPEKIMDGSNGSIADDSYNLYKEDVNLLHQIGFDAYRFSISWSRILPRGTLKGGINQAGIEYYNNLINQLISKGVKPFVTLFHWDLPDALENAYGGLLGDEFVNDFRDYAELCFQKFGDRVKQWTTLNEPYTMVHEGYITGQKAPGRCSNFYKPDCLGGDAATEPYIVGHNLLLAHGVAVKVYREKYQATQKGEIGIALNTAWHYPYSDSYADRLAATRATAFTFDYFMEPIVYGRYPIEMVSHVKDGRLPTFTPEESEMLKGSYDFIGVNYYSSLYAKDVPCATENITMTTDSCVSLVGERNGVPIGPAAGSDWLLIYPKGIRDLLLHAKFRYNDPVLYITENGVDEANIGKIFLNDDLRIDYYAHHLKMVSDAISIGVNVKGYFAWSLMDNFEWSEGYTVRFGLVFVDFEDGRKRYLKKSAKWFRRLLKGAHGGTNEQVAVI

SEQ ID NO: 45 - DNA, 950 bp, Arabidopsis thaliana
  misc_feature (1)..(950): Ceres PROMOTER  YP0244
aaagtcttatttgtgaaattttacaaatgttggaaaaaagcattttatggtgctatatttgtcaatttcccttgattatatatccttttgaaaagtaatgttttttttatgtgtgtgtattcatgaaccttggaaaaactacaaatcagatcatggtttgttttaggtgaaaaatttagaacacagttacgcaagaaagatatcggtaaatttttgtttctttgaatcgaaattaatcaaaaagtattttccattatataacaacaactaatctctgttttttttttttttttttaacaactaatctcttatcaaaatgacactacagaatcacgattgtaaatctttaaaaggcagtctgaaaaatattcatgaggatgagattttattcattcatggttgtaagtaatcattatgtaaagtttaggataaggacgttcaaaatcatataaaaaaactctacgaataaagtttatagtctatcatattgattcatatttcatagaaagttactggaaaacattacacaagtattctcgatttttacgagtttgtttagtagtcgcaaaattttattttacttttgagtatacgaacccataagctgattttctttccaagttccaataatgatatcatagtgtactcttcatgaatgtttcaagcatataattataacgttcataagtaatattctactgcatgtttgttattataaattaactaataatcgaacgtatgagttttgattgagattgttgtgctcacgaaatgaaggactcggtcaattctaaagcttaaaataagaagctcagatcttaaaactcgctttcgtcttcgtcctccatttaagtttgcgattcttttgctcttctttctctctcacatttttgtcccaaaacaataaaaagaaacaataatagaaagtgttacagaaaaagaaagaaaac

SEQ ID NO: 46 - DNA, 3048 bp, Arabidopsis thaliana
  misc_feature: Encoded by SEQ ID NO: 45
  misc_feature (1)..(3048): Ceres CDNA ID no. 12736016
  misc_feature (1)..(3048): Sequence of endogenous gene to Ceres PROMOTER  YP0244
atggagagttacctcaactcgaatttcgacgttaaggcgaagcattcgtcggaggaagtgctagaaaaatggcggaatctttgcagtgtcgtcaagaacccgaaacgtcggtttcgattcactgccaatctctccaaacgttacgaagctgctgccatgcgccgcaccaaccaggagaaattaaggattgcagttctcgtgtcaaaagccgcatttcaatttatctctggtgtttctccaagtgactacaaggtgcctgaggaagttaaagcagcaggctttgacatttgtgcagacgagttaggatcaatagtggaaggtcatgatgtgaagaagctcaagttccatggtggtgttgatggtctttcaggtaagctcaaggcatgtcccaatgctggtctctcaacaggtgaacctgagcagttaagcaaacgacaagagcttttcggaatcaataagtttgcagagagtgaattacgaagtttctgggtgtttgtttgggaagcacttcaagatatgactcttatgattcttggtgtttgtgctttcgtctctttgattgttgggattgcaactgaaggatggcctcaaggatcgcatgatggtcttggcattgttgctagtattcttttagttgtgtttgtgacagcaactagtgactatagacaatctttgcagttccgggatttggataaagagaagaagaagatcacggttcaagttacgcgaaacgggtttagacaaaagatgtctatatatgatttgctccctggagatgttgttcatcttgctatcggagatcaagtccctgcagatggtcttttcctctcgggattctctgttgttatcgatgaatcgagtttaactggagagagtgagcctgtgatggtgactgcacagaaccctttccttctctctggaaccaaagttcaagatgggtcatgtaagatgttggttacaacagttgggatgagaactcaatggggaaagttaatggcaacacttagtgaaggaggagatgacgaaactccgttgcaggtgaaacttaatggagttgcaaccatcattgggaaaattggtctttccttcgctattgttacctttgcggttttggtacaaggaatgtttatgaggaagctttcattaggccctcattggtggtggtccggagatgatgcattagagcttttggagtattttgctattgctgtcacaattgttgttgttgcggttcctgaaggtttaccattagctgtcacacttagtctcgcgtttgcgatgaagaagatgatgaacgataaagcgcttgttcgccatttagcagcttgtgagacaatgggatctgcaactaccatttgtagtgacaagactggtacattaacaacaaatcacatgactgttgtgaaatcttgcatttgtatgaatgttcaagatgtagctagcaaaagttctagtttacaatctgatatccctgaagctgccttgaaactacttctccagttgatttttaataataccggtggagaagttgttgtgaacgaacgtggcaagactgagatattggggacaccaacagagactgctatattggagttaggactatctcttggaggtaagtttcaagaagagagacaatctaacaaagttattaaagttgagccttttaactcaacaaagaaaagaatgggagtagtcattgagctgcctgaaggaggacgcattcgcgctcacacgaaaggagcttcagagatagttttagcggcttgtgataaagtcatcaactcaagtggtgaagttgttccgcttgatgatgaatccatcaagttcttgaatgttacaatcgatgagtttgcaaatgaagctcttcgtactctttgccttgcttatatggatatcgaaagcgggttttcggctgatgaaggtattccggaaaaagggtttacatgcatagggattgttggtatcaaagaccctgttcgtcctggagttcgggagtccgtggaactttgtcgccgtgcgggtattatggtgagaatggttacaggagataacattaacaccgcaaaggctattgctagagaatgtggaattctcactgatgatggtatagcaattgaaggtcctgtgtttagagagaagaaccaagaagagatgcttgaactcattcccaagattcaggtcatggctcgttcttccccaatggacaagcatacactggtgaagcagttgaggactacttttgatgaagttgttgctgtgactggcgacgggacaaacgatgcaccagcgctccacgaggctgacataggattagcaatgggcattgccgggactgaagtagcgaaagagattgcggatgtcatcattctcgacgataacttcagcacaatcgtcaccgtagcgaaatggggacgttctgtttacattaacattcagaaatttgtgcagtttcaactaacagtcaatgttgttgcccttattgttaacttctcttcagcttgcttgactggaagtgctcctctaactgctgttcaactgctttgggttaacatgatcatggacacacttggagctcttgctctagctacagaacctccgaacaacgagctgatgaaacgtatgcctgttggaagaagagggaatttcattaccaatgcgatgtggagaaacatcttaggacaagctgtgtatcaatttattatcatatggattctacaggccaaagggaagtccatgtttggtcttgttggttctgactctactctcgtattgaacacacttatcttcaactgctttgtattctgccaggttttcaatgaagtaagctcgcgggagatggaagagatcgatgttttcaaaggcatactcgacaactatgttttcgtggttgttattggtgcaacagttttctttcagatcataatcattgagttcttgggcacatttgcaagcaccacacctcttacaatagttcaatggttcttcagcattttcgttggcttcttgggtatgccgatcgctgctggcttgaagaaaatacccgtgtga

SEQ ID NO: 47 - protein, 1015 aa, Arabidopsis thaliana
  misc_feature (1)..(1015): Ceres CDNA ID no. 12736016
  misc_feature (1)..(1015): Sequence of endogenous gene to Ceres PROMOTER  YP0244
MESYLNSNFDVKAKHSSEEVLEKWRNLCSVVKNPKRRFRFTANLSKRYEAAAMRRTNQEKLRIAVLVSKAAFQFISGVSPSDYKVPEEVKAAGFDICADELGSIVEGHDVKKLKFHGGVDGLSGKLKACPNAGLSTGEPEQLSKRQELFGINKFAESELRSFWVFVWEALQDMTLMILGVCAFVSLIVGIATEGWPQGSHDGLGIVASILLVVFVTATSDYRQSLQFRDLDKEKKKITVQVTRNGFRQKMSIYDLLPGDVVHLAIGDQVPADGLFLSGFSVVIDESSLTGESEPVMVTAQNPFLLSGTKVQDGSCKMLVTTVGMRTQWGKLMATLSEGGDDETPLQVKLNGVATIIGKIGLSFAIVTFAVLVQGMFMRKLSLGPHWWWSGDDALELLEYFAIAVTIVVVAVPEGLPLAVTLSLAFAMKKMMNDKALVRHLAACETMGSATTICSDKTGTLTTNHMTVVKSCICMNVQDVASKSSSLQSDIPEAALKLLLQLIFNNTGGEVVVNERGKTEILGTPTETAILELGLSLGGKFQEERQSNKVIKVEPFNSTKKRMGVVIELPEGGRIRAHTKGASEIVLAACDKVINSSGEVVPLDDESIKFLNVTIDEFANEALRTLCLAYMDIESGFSADEGIPEKGFTCIGIVGIKDPVRPGVRESVELCRRAGIMVRMVTGDNINTAKAIARECGILTDDGIAIEGPVFREKNQEEMLELIPKIQVMARSSPMDKHTLVKQLRTTFDEVVAVTGDGTNDAPALHEADIGLAMGIAGTEVAKEIADVIILDDNFSTIVTVAKWGRSVYINIQKFVQFQLTVNVVALIVNFSSACLTGSAPLTAVQLLWVNMIMDTLGALALATEPPNNELMKRMPVGRRGNFITNAMWRNILGQAVYQFIIIWILQAKGKSMFGLVGSDSTLVLNTLIFNCFVFCQVFNEVSSREMEEIDVFKGILDNYVFVVVIGATVFFQIIIIEFLGTFASTTPLTIVQWFFSIFVGFLGMPIAAGLKKIPV

SEQ ID NO: 48 - DNA, 960 bp, Arabidopsis thaliana
  misc_feature (1)..(960): Ceres PROMOTER  YP0226
tcaaaagtgtaatttccacaaaccaattgcgcctgcaaaagttttcaaaggatcatcaaacataatgatgaatatctcatcaccacgattttataataatgcatcttttcccaccattttttttccctcactttcttttataatcttgttcgacaacaatcatggtctaaggaaaaagttgaaaatatatattatcttagttattagaaaagaaagataatcaaatggtcaatatgcaaatggcatatgaccataaacgagtttgctagtataaagaatgatggccaacctgttaaagagagactaaaattaggtctaaaatctaggagcaatgtaaccaatacatagtatatgaaatataaaagttaatttagattttttgattagcccaaattaaagaaaaatggtatttaaaacagagactcttcatcctaaaggctaaagcaatacaatttttggttaagaaaagaaaaaaaccacaagcggaaaagaaaacaaaaaagaactatattatgatgcaacagcaacacaaagcaaaaccttgcacacacacatacaactgtaaacaagtttcttgggactctctattttctcttgctgcttgaaccaaacacaacaacgatatcccaacgagagcacaacaggtttgattatgtcggaagacaagttttgagagaaaacaaacaatattttataacaaaggagaagacttttggttagaaaaaattggtatggccattacaagacatatgggtcccaattctcatcactctctccaccaccaaaatcctcctctctctctctctcttttactctgttttcatcatctctttctctcgtctctctcaaaccctaaatacactctttctcttcttgttgtctccattctctctgtgtcatcaagcttcttttttgtgtgggttatttgaaagacactttctctgctggtatcattggagt

SEQ ID NO: 49 - DNA, 1194 bp, Arabidopsis thaliana
  misc_feature: Encoded by SEQ ID NO: 48
  misc_feature (1)..(1194): Ceres CDNA ID no. 12327003
  misc_feature (1)..(1194): Sequence of endogenous gene to Ceres PROMOTER  YP0226
actctgttttcatcatctctttctctcgtctctctcaaaccctaaatacactctttctcttcttgttgtctccattctctctgtgtcatcaagcttcttttttgtgtgggttatttgaaagacactttctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctcttgtttatttgttctctcagattgtaaatagttgaagttatctaattaatgtgataagagttatgtttatgattcc

SEQ ID NO: 50 - protein, 239 aa, Arabidopsis thaliana
  misc_feature (1)..(239): Ceres CDNA ID no. 12327003
  misc_feature (1)..(239): Sequence of endogenous gene to Ceres PROMOTER  YP0226
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGTTCREKVKPLRLLDGSSDFVLTYEDKEGDWMLVGDVPWRMFINSVKRLRIMGTSEASGLAPRRQEQKDRQRNNPV

SEQ ID NO: 51 - DNA, 950 bp, Arabidopsis thaliana
  misc_feature (1)..(950): Ceres PROMOTER  PT0511
gacgggtcatcacagattcttcgtttttttatagatagaaaaggaataacgttaaaagtatacaaattatatgcaagagtcattcgaaagaattaaataaagagatgaactcaaaagtgattttaaattttaatgataagaatatacatctcacagaaatcttttatttgacatgtaaaatcttgttttcacctatcttttgttagtaaacaagaatatttaatttgagcctcacttggaacgtgataataatatacatcttatcataattgcatattttgcggatagtttttgcatggggagattaaaggcttaataaagccttgaatttccgaggggaggaatcatgttttatacttgcaaactatacaaccatctgcatcgataattggtgttaatacatgcaaggattatacactaaaacaaatcatttatttccttacaaaaagagagtcgactgtgagtcacattctgtgacaaggaaaggtcaagaaccatcgcttttatcatcattctctttgctaacaacttacaaccacacaaacgcaagagttccattctcatggagaagaacatattatgcaaaataatgtatgtcgatcgatagagaaaaggatccacaattattgctccatctcaaaagcttctttagtacacgatacatgtatcatgtaaatagaaatatgaaagatacaatacacgacccattctcataaagatagcaacatttcatgttatgtaaagagtcttccttaggacacatgcattaaaactaaggattaccaacccacttactcctcactccaaccaaatatcaatcatctattttgggtccttcactcataagtcaactctcatgccttcctctataaataccgtaccctacgcatcccttagttctacatcacataaaaacaatcatagcaaaaacatatatcctcaaattaatt

SEQ ID NO: 52 - DNA, 918 bp, Arabidopsis thaliana
  misc_feature: Encoded by SEQ ID NO: 51
  misc_feature (1)..(918): Ceres CDNA ID no. 12711931
  misc_feature (1)..(918): Sequence of endogenous gene to Ceres PROMOTER  PT0511
atggatcatgaggaaattccatccacgccctcaacgccggcgacaaccccggggactccaggagcgccgctctttggaggattcgaagggaagaggaatggacacaatggtagatacacaccaaagtcacttctcaaaagctgcaaatgtttcagtgttgacaatgaatgggctcttgaagatggaagactccctccggtcacttgctctctccctccccctaacgtttccctctaccgcaagttgggagcagagtttgttgggacattgatcctgatattcgccggaacagcgacggcgatcgtgaaccagaagacagatggagctgagacgcttattggttgcgccgcctcggctggtttggcggttatgatcgttatattatcgaccggtcacatctccggggcacatctcaatccggctgtaaccattgcctttgctgctctcaaacacttcccttggaaacacgtgccggtgtatatcggagctcaggtgatggcctccgtgagtgcggcgtttgcactgaaagcagtgtttgaaccaacgatgagcggtggcgtgacggtgccgacggtgggtctcagccaagctttcgccttggaattcattatcagcttcaacctcatgttcgttgtcacagccgtagccaccgacacgagagctgtgggagagttggcgggaattgccgtaggagcaacggtcatgcttaacatacttatagctggacctgcaacttctgcttcgatgaaccctgtaagaacactgggtccagccattgcagcaaacaattacagagctatttgggtttacctcactgcccccattcttggagcgttaatcggagcaggtacatacacaattgtcaagttgccagaggaagatgaagcacccaaagagaggaggagcttcagaagatga

SEQ ID NO: 53 - protein, 305 aa, Arabidopsis thaliana
  misc_feature (1)..(305): Ceres CDNA ID no. 12711931
  misc_feature (1)..(305): Sequence of endogenous gene to Ceres PROMOTER  PT0511
MDHEEIPSTPSTPATTPGTPGAPLFGGFEGKRNGHNGRYTPKSLLKSCKCFSVDNEWALEDGRLPPVTCSLPPPNVSLYRKLGAEFVGTLILIFAGTATAIVNQKTDGAETLIGCAASAGLAVMIVILSTGHISGAHLNPAVTIAFAALKHFPWKHVPVYIGAQVMASVSAAFALKAVFEPTMSGGVTVPTVGLSQAFALEFIISFNLMFVVTAVATDTRAVGELAGIAVGATVMLNILIAGPATSASMNPVRTLGPAIAANNYRAIWVYLTAPILGALIGAGTYTIVKLPEEDEAPKERRSFRR

SEQ ID NO: 54 - DNA, 1100 bp, Arabidopsis thaliana
  misc_feature (1)..(1100): Ceres PROMOTER  PT0506
cgctccagaccactgtttgctttcctctgattaaccaatctcaattaaactactaatttataattcaagataattagataaccaatcttaaaatttggaatcttcttccctcacttgatattacaaaaaaaaaactgatttatcatacggttaattcaagaaaacagcaaaaaaattgcactataatgcaaaacatcaattaattacattcgattaaaaaatcatcattgaatctaaaatggcctcaaatctattgagcatttgtcatgtgcctaaaatggttcaggagttttacatctaatcacataaaaagcaaacaataaccaaaaaaattgcattttagcaaatcaaatacttatatatatacgtatgattaagcgtcatgactttaaaacctctgtaaaattttgatttatttttcgatgcttttattttttaaccaatagtaataaagtccaaatcttaaatacgaaaaaatgtttctttctaagcgaccaacaaaatggtccaaatcacagaaaatgttccataatccaggcccattaagctaatcaccaagtaatacattacacgtcaccaattaatacattacacgtacggccttctctcttcacgagtaatatgcaaacaaacgtacattagctgtaatgtactcactcatgcaacgtcttaacctgccacgtattacgtaattacaccactccttgttcctaacctacgcatttcactttagcgcatgttagtcaaaaaacacaaacataaactacaaataaaaaaactcaaaacaaaacccaatgaacgaacggaccagccccgtctcgattgatggaacagtgacaacagtcccgttttctcgggcataacggaaacggtaaccgtctctctgtttcatttgcaacaacaccatttttataaataaaaacacatttaaataaaaaattattaaaacctatatccaaacaaatgaatgtgttaaaccttcactcttctctccacacaaaattcaaaaacctcacatttcacttctctcttctcgcttcttctagatctcaccggtttatctagctccggtttgattcatctccggttatggggagaga

SEQ ID NO: 55 - DNA, 2017 bp, Arabidopsis thaliana
  misc_feature: Encoded by SEQ ID NO: 54
  misc_feature (1)..(2017): Ceres CDNA ID no. 13497447
  misc_feature (1)..(2017): Sequence of endogenous gene to Ceres PROMOTER  PT0506
atatatccaaacaaatgaatgtgttaaaccttcactcttctctccacacaaaattcaaaaacctcacatttcacttctctcttctcgcttcttctagatctcaccggtttatctagctccggtttgattcatctccggttatggggagagaatgaggagttaccgttttagtgattatctacacatgtctgtttcattctctaacgatatggatttgttttgtggagaagactccggtgtgttttccggtgagtcaacggttgatttctcgtcttccgaggttgattcatggcctggtgattctatcgcttgttttatcgaagacgagcgtcacttcgttcctggacatgattatctctctagatttcaaactcgatctctcgatgcttccgctagagaagattccgtcgcatggattctcaaggtacaagcgtattataactttcagcctttaacggcgtacctcgccgttaactatatggatcggtttctttacgctcgtcgattaccggaaacgagtggttggccaatgcaacttttagcagtggcatgcttgtctttagctgcaaagatggaggaaattctcgttccttctctttttgattttcaggttgcaggagtgaagtatttatttgaagcaaaaactataaaaagaatggaacttcttgttctaagtgtgttagattggagactaagatcggttacaccgtttgatttcattagcttctttgcttacaagatcgatccttcgggtacctttctcgggttctttatctcccatgctacagagattatactctccaacataaaagaagcgagctttcttgagtactggccatcgagtatagctgcagccgcgattctctgtgtagcgaacgagttaccttctctatcctctgttgtcaatccccacgagagccctgagacttggtgtgacggattgagcaaagagaagatagtgagatgctatagactgatgaaagcgatggccatcgagaataaccggttaaatacaccaaaagtgatagcaaagcttcgagtgagtgtaagggcatcatcgacgttaacaaggccaagtgatgaatcctctttctcatcctcttctccttgtaaaaggagaaaattaagtggctattcatgggtaggtgatgaaacatctacctctaattaaaatttggggagtgaaagtagaggaccaaggaaacaaaacctagaagaaaaaaaaccctcttctgtttaagtagagtatattttttaacaagtacatagtaataagggagtgatgaagaaaagtaaaagtgtttattggctgagttaaagtaattaagagttttccaaccaaggggaaggaataagagttttggttacaatttcttttatggaaagggtaaaaattgggttttggggttggttggttggttgggagagacgaagctcatcattaatggctttgcagattcccaagaaagcaaaatgagtaagtgagtgtaacacacacgtgttagagaaaagatatgatcatgtgagtgtgtgtgtgtgagagagagagagaagagtatttgcattagagtcctcatcacacaggtactgatggataagacaggggagcgtttgcaaaagatttgtgagtggagatttttctgagctctttgtcttaatggatcgcagcagttcatgggacccttcctcagcttcatcatcaaacaaaaaaaaaatcaagttgcgaagtatatataatttgtttttttgtttggatttttaagatttttgattccttgtgtgtgacttcacgtgacggaggcgtgtgtctcacgtgtttgttttctcttcaaatcttttattttggcgggaaattttgtgtttttgatttctacgtattcgtggactccaaatgagttttgtcacggtgcgttttagtagcgtttgcatgcgtgtaaggtgtcacgtatgtgtatatatatgatttttttttggtttcttgaaaggttgaattttataaataaaacgtttctattat

SEQ ID NO: 56 - protein, 339 aa, Arabidopsis thaliana
  misc_feature (1)..(339): Ceres CDNA ID no. 13497447
  misc_feature (1)..(339): Sequence of endogenous gene to Ceres PROMOTER  PT0506
MRSYRFSDYLHMSVSFSNDMDLFCGEDSGVFSGESTVDFSSSEVDSWPGDSIACFIEDERHFVPGHDYLSRFQTRSLDASAREDSVAWILKVQAYYNFQPLTAYLAVNYMDRFLYARRLPETSGWPMQLLAVACLSLAAKMEEILVPSLFDFQVAGVKYLFEAKTIKRMELLVLSVLDWRLRSVTPFDFISFFAYKIDPSGTFLGFFISHATEIILSNIKEASFLEYWPSSIAAAAILCVANELPSLSSVVNPHESPETWCDGLSKEKIVRCYRLMKAMAIENNRLNTPKVIAKLRVSVRASSTLTRPSDESSFSSSSPCKRRKLSGYSWVGDETSTSN

SEQ ID NO: 57 - DNA, 950 bp, Arabidopsis thaliana
  misc_feature (1)..(950): Ceres PROMOTER  YP0377
tttaaacataacaatgaattgcttggatttcaaactttattaaatttggattttaaattttaatttgattgaattatacccccttaattggataaattcaaatatgtcaactttttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaactgctggcaaccacttttgccgcgtttaatttctttctgaggcttatataaatagatcaaaggggaaagtgagatat

SEQ ID NO: 58 - DNA, 703 bp, Arabidopsis thaliana
  misc_feature: Encoded by SEQ ID NO: 57
  misc_feature (1)..(703): Ceres CDNA ID no. 13613778
  misc_feature (1)..(703): Sequence of endogenous gene to Ceres PROMOTER  YP0377
aaagaaaatgggtttgagaagaacatggttggttttgtacattctcttcatctttcatcttcagcacaatcttccttccgtgagctcacgaccttcctcagtcgatacaaaccacgagactctcccttttagtgtttcaaagccagacgttgttgtgtttgaaggaaaggctcgggaattagctgtcgttatcaaaaaaggaggaggtggaggaggtggaggacgcggaggcggtggagcacgaagcggcggtaggagcaggggaggaggaggtggcagcagtagtagccgcagccgtgactggaaacgcggcggaggggtggttccgattcatacgggtggtggtaatggcagtctgggtggtggatcggcaggatcacatagatcaagcggcagcatgaatcttcgaggaacaatgtgtgcggtctgttggttggctttatcggttttagccggtttagtcttggttcagtagggttcagagtaattattggccatttatttattggttttgtaacgtttatgtttgtggtccggtctgatatttatttgggcaaacggtacattaaggtgtagactgttaatattatatgtagaaagagattcttagcaggattctactggtagtattaagagtgagttatctttagtatgccatttgtaaatggaaatttaatgaaataagaaattgtgaaatttaaac

SEQ ID NO: 59 - protein, 157 aa, Arabidopsis thaliana
  misc_feature (1)..(157): Ceres CDNA ID no. 13613778
  misc_feature (1)..(157): Sequence of endogenous gene to Ceres PROMOTER  YP0377
KKMGLRRTWLVLYILFIFHLQHNLPSVSSRPSSVDTNHETLPFSVSKPDVVVFEGKARELAVVIKKGGGGGGGGRGGGGARSGGRSRGGGGGSSSSRSRDWKRGGGVVPIHTGGGNGSLGGGSAGSHRSSGSMNLRGTMCAVCWLALSVLAGLVLVQ

SEQ ID NO: 60 - DNA, 1952 bp, Arabidopsis thaliana
  misc_feature (1)..(1952): Predicted sequence of Ceres PROMOTER  YP0001
ctgcattcacacatattttgggctctcacgtgtttgtgaatttaatatatttgactacacgatctttcaacgtatgaaaaagttttatactactattttcgtttgagtgggaaataaacaaatgatagctacagttatctatatggtataattttacacttttataactaataatgatgagtgatgacaatcgagtgtcggatataacaggccaacaagtggaatggacttatgtaactttttaatcacgggattaaatcacgtaacccaatgtcctaattggtatttaattttgattatctcgatgctacatattgtcataggactcatatctttgatcacgtgccgctaccaatccagacattttagtatacaaaaaaaaagaagatacaaacttaagatatggaatatatatcagaactatcagttttagactttaataattcgaattgaataactacgatcaatatataaattggcaaatagattggtcaattgtagtgcaagaaatttgtgaactttattacagtacgaagagagtaagagaagcaagatccggtttttaggcaacaagtaacatttttgagttcagagagtttgcttcttactttaagttacgtcactacaaaagccaagttcctacttcttaggtctaaagtcaattttcgaatattcagaaaaattgtactctactagatcgaatagttttcaccggtgaaacgatatataaatgaagactacaatattttttaatttttttaagcgtatgagttctagacctttggcacgtaaatttctccggtacctgggaccaatcgttgataatatcacgtttaagatttaatcatccatcccaagtagagttgaactagtaaccttgagcactttttctcgagacaactaaaccatcatccacttagtgcaataaagcgtcattcttttttttcttttcaaaaattcgtatttaattttaatttattaaaaatatttcttttgttttaaattgggacagaattatcatttaacatatttaaaatttatatttttaattaaaaatagggtaaaatatatttttcaaacaaaaattcaaaaatagggcaattttcaaaatcatccattcttaaatctaaagtcggctacagtcttttcgttgttttgttgctaatttcaatttatatacatgcaaattacaaaatataatagtttttgggggataattatcttcttgcgcctttttattaaattaatatgctcatatagcagttcttacaattaatataactagggttttaaatttcaatatcgagttgacaaaatgaattgtttacaagtttttttcttttcaatatgcattgttcatcacgtattcgtagtgatgcaaaaacaaactataaattataattgcactagtgagattagcaagaagtgttataaattagaataaacggaactatcaaactgtgttatgtacaccatttatttttgttaaagaatatgtgtagtagttagaaaactgatcaaattaaactgaaaattcacattacggagatcaagttacattgtctattgatgaaaaaaacaaaataaatccaaatggcactaaaagttgtagaaattgaaagaagaaaatagatttttgtctaggaataaaagtcaaaatgggaaagacaaaaaaaagagaggcaaataagcagtgatggagctaaagcaacgctttactcttttaattatgaattatttgatttgacctccactcgcctggctttttttggttgttctttatagaaaagtaaaataacacaattagcacataacatgagttatcgagaaaccaattctctttgtggtgttttagttaatttctataacttatgaaaccattttctcagtttatcatgataattgatcctctatttaaaaccctaaagtttatattttgtttgttcaaacac

SEQ ID NO: 61 - DNA, 2039 bp, Arabidopsis thaliana
  misc_feature (1)..(2039): Experimental sequence of Ceres PROMOTER  YP0001
  misc_feature (2023)..(2023): n is a, c, t, g, unknown, or other
ctgcattcacacatattttgggctctcacgtgtttgtgaatttaatatatttgactacacgatctttcaacgtatgaaaaagttttatactactattttcgtttgagtgggaaataaacaaatgatagctacagttatctatatggtataattttacacttttataactaataatgatgagtgatgacaatcgagtgtcggatataacaggccaacaagtggaatggacttatgtaactttttaatcacgggattaaatcacgtaacccaatgtcctaattggtatttaattttgattatctcgatgctacatattgtcataggactcatatctttgatcacgtgccgctaccaatccagacattttagtatacaaaaaaaaagaagatacaaacttaagatatggaatatatatcagaactatcagttttagactttaataattcgaattgaataactacgatcaatatataaattggcaaatagattggtcaattgtagtgcaagaaatttgtgaactttattacagtacgaagagagtaagagaagcaagatccggtttttaggcaacaagtaacatttttgagttcagagagtttgcttcttactttaagttacgtcactacaaaagccaagttcctacttcttaggtctaaagtcaattttcgaatattcagaaaaattgtactctactagatcgaatagttttcaccggtgaaacgatatataaatgaagactacaatattttttaatttttttaagcgtatgagttctagacctttggcacgtaaatttctccggtacctgggaccaatcgttgataatatcacgtttaagatttaatcatccatcccaagtagagttgaactagtaaccttgagcactttttctcgagacaactaaaccatcatccacttagtgcaataaagcgtcattcttttttttcttttcaaaaattcgtatttaattttaatttattaaaaatatttcttttgttttaaattgggacagaattatcatttaacatatttaaaatttatatttttaattaaaaatagggtaaaatatatttttcaaacaaaaattcaaaaatagggcaattttcaaaatcatccattcttaaatctaaagtcggctacagtcttttcgttgttttgttgctaatttcaatttatatacatgcaaattacaaaatataatagtttttgggggataattatcttcttgcgcctttttattaaattaatatgctcatatagcagttcttacaattaatataactagggttttaaatttcaatatcgagttgacaaaatgaattgtttacaagtttttttcttttcaatatgcattgttcatcacgtattcgtagtgatgcaaaaacaaactataaattataattgcactagtgagattagcaagaagtgttataaattagaataaacggaactatcaaactgtgttatgtacaccatttatttttgttaaagaatatgtgtagtagttagaaaactgatcaaattaaactgaaaattcacattacggagatcaagttacattgtctattgatgaaaaaaacaaaataaatccaaatggcactaaaagttgtagaaattgaaagaagaaaatagatttttgtctaggaataaaagtcaaaatgggaaagacaaaaaaaagagaggcaaataagcagtgatggagctaaagcaacgctttactcttttaattatgaattatttgatttgacctccactcgcctggctttttttggttgttctttatagaaaagtaaaataacacaattagcacataacatgagttatcgagaaaccaattctctttgtggtgttttagttaatttctataacttatgaaaccattttctcagtttatcatgataattgatcctctatttaaaaccctaaagtttatattttgtttgttcaaacacagtcgccattgcactgggatccaacaatgtcctccgactcgtccaagatcaagaggaagcggaaccgcatncctttaacgaaggcga

SEQ ID NO: 62 - DNA, 2322 bp, Arabidopsis thaliana
  misc_feature: Encoded by SEQ ID NO: 61
  misc_feature (1)..(2322): Ceres CDNA ID no. 12736079
  misc_feature (1)..(2322): Sequence of endogenous gene to Ceres PROMOTER  YP0001
atgaaaacacaatcagcttcaccgttcttcttcgtctccttcttcttcttcttcttcttcttctcttctctgtttcttctctcctctgctttaaactctgatggagttctcttactgagtttcaaatactctgttcttcttgatcctctctctttattacaatcatggaactacgaccacgacaatccttgttcatggcgaggtgtgttgtgtaataacgattcaagagttgttactttatctctcccaaactctaacctcgttggttcgattccttccgatctgggtttcctccaaaacctccaaagtcttaatctttccaataattcactcaatgggtcattaccggttgagtttttcgccgccgataagctccggtttcttgatttatcaaataacttgatctccggcgagatccctgtatcaatcggaggtttacacaacctccagacgttaaatctctccgataacatcttcaccgggaaactaccagctaacttagcgtctcttggaagcttaacggaggtttctctgaagaacaactacttctccggcgagtttcccggcggcggatggagatcggttcagtatctagacatttcttcaaatctaatcaacggttcactcccacctgatttctccggcgacaatctccgatacctgaatgtctcgtataaccaaatctccggagagattcctccgaatgttggtgccggttttcctcaaaacgccaccgttgatttctccttcaacaatttaaccggttcaatcccagattctccggtttaccttaaccagaaatcaatttcgttttccggaaacccgggtttatgcggaggtccgacccgaaacccgtgtcccattccttcatctccggccaccgtctcgccaccaacctctacacctgcactcgcagctatacctaaatcaatcgggtctaatcgagaaaccgaaccgaacaacaactcaaatcctcgaaccgggttaagaccaggagttataatcggaatcatagtcggagatatcgccggaatcggaatcctcgctcttatcttcttctacgtttataaatacaaaaacaacaagacagtggagaagaagaacaatcatagcctagaagctcatgaagctaaagacacaacttcgttatcaccatcatcatcaacaactacatcttcttcatctccagaacaatcaagcagatttgcaaaatggtcatgtctccgtaagaatcaagaaaccgatgaaaccgaagaagaagacgaagaaaatcaacggtcaggagagattggagagaataagaaagggactttagtaaccattgatggaggagagaaagagcttgaagttgaaactttgcttaaggcttctgcttacattttaggagccactggttcgagtataatgtacaagactgttcttgaggacggtacggttctcgcggttcgtcggttaggtgagaatggtttgagtcaacaacgccggtttaaagactttgaggcacatattcgagctattggtaaattggttcacccgaatttggtacgtcttcgtggattctattggggcaccgacgagaaattggtcatttacgattttgttcctaacggcagtctcgtcaacgcccgttacaggaaaggagggtcttcgccgtgccatttaccgtgggagactcggctcaagatagtaaaaggtttggctcgtgggcttgcttacctccacgacaagaaacatgtgcacggtaacttgaagcctagtaacatactcttgggccaagatatggagcccaagatcggagatttcgggctcgaaaggcttctcgccggggatactagctataaccgagctagtggatcatctcggattttcagtagcaagcgattgacagcatcctcgcgtgaatttggtaccatcgggcccacaccgagcccaagtccaagctccgttgggcccatatctccctattgcgcacccgagtcgctccgcaatctcaaaccaaacccgaaatgggatgtgtttgggtttggagtgatcctcctcgagctgctcacgggaaaaatagtgtcgatagacgaggtgggggtaggaaatgggctgaccgtagaggacgggaaccgggcgctaataatggctgatgtagcgatccgctccgaattggaaggcaaagaggactttttacttggccttttcaaattgggatatagttgtgcatctcaaattccacaaaagagaccgaccatgaaagaggcgttagtagtgtttgaaagatatcctattagctcatcggctaagagtccatcgtaccattacggacactattaa

SEQ ID NO: 63 - protein, 773 aa, Arabidopsis thaliana
  misc_feature (1)..(773): Ceres CDNA ID no. 12736079
  misc_feature (1)..(773): Sequence of endogenous gene to Ceres PROMOTER  YP0001
MKTQSASPFFFVSFFFFFFFFSSLFLLSSALNSDGVLLLSFKYSVLLDPLSLLQSWNYDHDNPCSWRGVLCNNDSRVVTLSLPNSNLVGSIPSDLGFLQNLQSLNLSNNSLNGSLPVEFFAADKLRFLDLSNNLISGEIPVSIGGLHNLQTLNLSDNIFTGKLPANLASLGSLTEVSLKNNYFSGEFPGGGWRSVQYLDISSNLINGSLPPDFSGDNLRYLNVSYNQISGEIPPNVGAGFPQNATVDFSFNNLTGSIPDSPVYLNQKSISFSGNPGLCGGPTRNPCPIPSSPATVSPPTSTPALAAIPKSIGSNRETEPNNNSNPRTGLRPGVIIGIIVGDIAGIGILALIFFYVYKYKNNKTVEKKNNHSLEAHEAKDTTSLSPSSSTTTSSSSPEQSSRFAKWSCLRKNQETDETEEEDEENQRSGEIGENKKGTLVTIDGGEKELEVETLLKASAYILGATGSSIMYKTVLEDGTVLAVRRLGENGLSQQRRFKDFEAHIRAIGKLVHPNLVRLRGFYWGTDEKLVIYDFVPNGSLVNARYRKGGSSPCHLPWETRLKIVKGLARGLAYLHDKKHVHGNLKPSNILLGQDMEPKIGDFGLERLLAGDTSYNRASGSSRIFSSKRLTASSREFGTIGPTPSPSPSSVGPISPYCAPESLRNLKPNPKWDVFGFGVILLELLTGKIVSIDEVGVGNGLTVEDGNRALIMADVAIRSELEGKEDFLLGLFKLGYSCASQIPQKRPTMKEALVVFERYPISSSAKSPSYHYGHY

SEQ ID NO: 64 - DNA, 999 bp, Arabidopsis thaliana
  misc_feature (1)..(999): Predicted sequence of Ceres PROMOTER  YP0033
aaacttccaaatttctaaacggatgcaataagaacttacatattctctttcattagtcatttattggccagatttattaaaaaaagttttactcaatgaccaaggattagagttaaagataatatagattattacatatattattcgaaaaaatatacgcatgtccgactttttaaacctcaaaaatatcaaaaccagaaaagatgataccacacaaaaaaacaataaaataataagtggaagagatatcatcggacaacagtacaagtacagcaccagctctgccaaaagccaaaaccatttgtcaattacagaaagatactattgtttgcaattactaaattacccctcggactttacaaaagcatctctaacttatccacgtgtcagtcatctattgattgtttcaataccaccttgtattaacgccccacgattcgtggttgggtacacctgatagtccgaggatatttaaatctcacgcgctcgtgtctataattcgactgtactcgcttttcttgtcgtgattttagcaatttacgaagtcaaatgtttgactcaatcagacttgcgcataagagagcgagtataaatgtttactatactcacgcaagtggggctttattgaaactactcttttgtaataaaaccagcagtggttttgttctgaatccgctctcttgccatatataccacaaacagaaaccacagaagatatcttttgagaaggaaaaaaaaaaagaagcttctcctcttcctctgccttcttctttccatttattgcaaaccctgatcaagtaagtcaaatcttcacgaacacatatgtatataaattcaatccaagaaactaggagaaatctatgaaagaggacaaatctaagtcaagtttgaatcaggaagattatctagatttgatcattttgacatttacgatgtgcttacttattcttgataaactttgatgcagttggttttggtgttagtcttttggggagagag

SEQ ID NO: 65 - DNA, 18 bp, Arabidopsis thaliana
  misc_feature (1)..(18): Experimental sequence of Ceres PROMOTER  YP0033
gtcgattggaacttccaa

SEQ ID NO: 66 - DNA, 1025 bp, Arabidopsis thaliana
  misc_feature: Encoded by SEQ ID NO: 65
  misc_feature (1)..(1025): Ceres CDNA ID no. 12370148
  misc_feature (1)..(1025): Sequence of endogenous gene to Ceres PROMOTER  YP0033
attcccacttccacacatacacatatacaacagagcaagagagtcaatcaagtagagtgaagatggcaactaaacaagaagctttagccatcgatttcataagccaacaccttctcacagactttgtttccatggaaactgatcacccatctctttttaccaaccaacttcacaactttcactcagaaacaggccctagaaccatcaccaaccaatcccctaaaccgaattcgactcttaaccagcgtaaaccgcccttaccgaatctatccgtctcgagaacggtttcaacaaagacagagaaagaggaagaagagaggcactacaggggagtgagacgaagaccgtggggaaaatacgcggcggagattagggatccgaacaaaaagggttgtaggatctggcttgggacttacgacactgccgtggaagctggaagagcttatgaccaagcggcgtttcaattacgtggaagaaaagcaatcttgaatttccctctcgatgttagggttacgtcagaaacttgttctggggaaggagttatcggattagggaaacgaaagcgagataagggttctccgccggaagaggagaaggcggctagggttaaagtggaggaagaagagagtaatacgtcggagacgacggaggctgaggttgagccggtggtaccattgacgccgtcaagttggatggggttttgggatgtgggagcaggagatggtattttcagtattcctccgttatctccgacgtctcccaacttttccgttatctccgtcacttaaaacttcggaaaagtcaacgtacgatgacgttttcacttgcgtcactctcatgatttcatttattcttgtataatataaaggtagcggtagtgtgcaaatatcaaataagtagtttaattagtaccaatcattttattcattattttttttagtagaatatttggatgttgaaaatataaatttaattttgtatttgttgatgttataaatttattgattgtataaacattcttagtc

SEQ ID NO: 67 - protein, 241 aa, Arabidopsis thaliana
  misc_feature (1)..(241): Ceres CDNA ID no. 12370148
  misc_feature (1)..(241): Sequence of endogenous gene to Ceres PROMOTER  YP0033
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTPSSWMGFWDVGAGDGIFSIPPLSPTSPNFSVISVT

SEQ ID NO: 68 - DNA, 999 bp, Arabidopsis thaliana
  misc_feature (1)..(999): Predicted sequence of Ceres PROMOTER  YP0214
cgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttcc

SEQ ID NO: 69 - DNA, 450 bp, Arabidopsis thaliana
  misc_feature (1)..(450): Experimental sequence of Ceres PROMOTER  YP0214
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactactt

SEQ ID NO: 70 - DNA, 1472 bp, Arabidopsis thaliana
  misc_feature: Encoded by SEQ ID NO: 69
  misc_feature (1)..(1472): Ceres CDNA ID no. 12705056
  misc_feature (1)..(1472): Sequence of endogenous gene to Ceres PROMOTER  YP0214
aaatacacctaacttgtttagtacacaacagcaacatcaaactctaataaacccaagttggtgtatactataatggtgatggctggtgcttcttctttggatgagatcagacaggctcagagagctgatggacctgcaggcatcttggctattggcactgctaaccctgagaaccatgtgcttcaggcggagtatcctgactactacttccgcatcaccaacagtgaacacatgaccgacctcaaggagaagttcaagcgcatgtgcgacaagtcgacaattcggaaacgtcacatgcatctgacggaggaattcctcaaggaaaacccacacatgtgtgcttacatggctccttctctggacaccagacaggacatcgtggtggtcgaagtccctaagctaggcaaagaagcggcagtgaaggccatcaaggagtggggccagcccaagtcaaagatcactcatgtcgtcttctgcactacctccggcgtcgacatgcctggtgctgactaccagctcaccaagcttcttggtctccgtccttccgtcaagcgtctcatgatgtaccagcaaggttgcttcgccggcggtactgtcctccgtatcgctaaggatctcgccgagaacaatcgtggagcacgtgtcctcgttgtctgctctgagatcacagccgttaccttccgtggtccctctgacacccaccttgactccctcgtcggtcaggctcttttcagtgatggcgccgccgcactcattgtggggtcggaccctgacacatctgtcggagagaaacccatctttgagatggtgtctgccgctcagaccatccttccagactctgatggtgccatagacggacatttgagggaagttggtctcaccttccatctcctcaaggatgttcccggcctcatctccaagaacattgtgaagagtctagacgaagcgtttaaacctttggggataagtgactggaactccctcttctggatagcccaccctggaggtccagcgatcctagaccaggtggagataaagctaggactaaaggaagagaagatgagggcgacacgtcacgtgttgagcgagtatggaaacatgtcgagcgcgtgcgttctcttcatactagacgagatgaggaggaagtcagctaaggatggtgtggccacgacaggagaagggttggagtggggtgtcttgtttggtttcggaccaggtctcactgttgagacagtcgtcttgcacagcgttcctctctaaacagaacgcttgccttctatctgcctacctacctacgcaaaactttaatcctgtcttatgttttatataatataatcattatatgtttacgcaataattaaggaagaattcatttgatgtgatatgtgatatgtgctggacaggtctattcgactgtttttgtactctcttttttgtgtctttttacaatattaaatctatgggtcttgaat

SEQ ID NO: 71 - protein, 395 aa, Arabidopsis thaliana
  misc_feature (1)..(395): Ceres CDNA ID no. 12705056
  misc_feature (1)..(395): Sequence of endogenous gene to Ceres PROMOTER  YP0214
MVMAGASSLDEIRQAQRADGPAGILAIGTANPENHVLQAEYPDYYFRITNSEHMTDLKEKFKRMCDKSTIRKRHMHLTEEFLKENPHMCAYMAPSLDTRQDIVVVEVPKLGKEAAVKAIKEWGQPKSKITHVVFCTTSGVDMPGADYQLTKLLGLRPSVKRLMMYQQGCFAGGTVLRIAKDLAENNRGARVLVVCSEITAVTFRGPSDTHLDSLVGQALFSDGAAALIVGSDPDTSVGEKPIFEMVSAAQTILPDSDGAIDGHLREVGLTFHLLKDVPGLISKNIVKSLDEAFKPLGISDWNSLFWIAHPGGPAILDQVEIKLGLKEEKMRATRHVLSEYGNMSSACVLFILDEMRRKSAKDGVATTGEGLEWGVLFGFGPGLTVETVVLHSVPL

SEQ ID NO: 72 - DNA, 998 bp, Arabidopsis thaliana
  misc_feature (1)..(998): Predicted sequence of Ceres PROMOTER  YP0216
tttgtttctaatagtttgatgtttatatcaacattattatttactttcatttgttaccgatagaaagaggagaaaattgttgacaaaaacaaagaaaaaagtaaaattaatattattaaattaataaaaataacaaactgtaaaagctatttttaaaaatttttcttgtaaaacatctaaaaattattcttgtagaaacagaggaatatcattgaagataatagtgtgaaattatatatatatatagaaatatataaagtaggatttttttctgtatacaaatatacgtttccaattttatcaaaaactgtaaagatttttttctttgtcagtacctgctaaacttgttaatttttttattaaaaaaaaatcaaattacaattcttctataatcattttaaattccatttctttataccacaaaagattatattgcctttatcgtctttggtatgtatgcgtgaatatatttatttattttcttttctttcattttctttttaaagaactttataaatgaaataaggaacaaacaatatacacatgtactaacgtatataaataatatcatcaatatctatccaaaacttggatttcatggttgacgtggcccaaccaaaatctcaagttctctgcggatgacgaaccatctcaccatctctttttttctctctcttttttttttttaatatcatcagcacggttacataaaattcgtgatccatgaagttggctttcttgtcgttttacttcatcaccccatttttttaaagtctccatctttatacttcttcaactctccaccaccaccattgtcaccaccacatttaaacacacactttcacttgtagtgggattcgaaagtgcgttttattcatttgttttactgtttttgataacctcaaaatttgcctaaattttattctctataaatccttatatgttttacttacattcctaaagttttcaactttcttgagcttcaaaaagtacctcca

SEQ ID NO: 73 - DNA, 676 bp, Arabidopsis thaliana
  misc_feature (1)..(676): Experimental sequence of Ceres PROMOTER  YP0216
  misc_feature (453)..(453): n is a, c, t, g, unknown, or other
ttttgtttctaatagtttgatgtttatatcaacattattatttactttcatttgttaccgatagaaagaggagaaaattgttgacaaaaacaaagataaaagtaaaattaatattattaaattaataaaaataacaaactgtaaaagctatttttttaaaaattttgtgtaaaacatctaaaaattattcttttagaaacagaagaatatcattgaagataatagtgtgaaattatatatatatatagaaatatataaagtaggatttttttctgtatacaaatatacgtttccaattttatcaaaaactgtaaagatttttttctttgtcagtacctgctaaacttgttaatttttttattaaaaaaaaatcaaattacaattcttctataatcattttaaattccatttctttataccacaaaagattatattgcctttatcgtctttggnatgtatgcgtgaatatatttatttattttcttttctttcattttctttttaaagaactttataaatgaaataaggaacaaacaatatacatatgtactaacgtatataaataatatcatcaatatctatccaaaacttggatttcatggttgacgtggcccaaccaaaatctcaagttctctgcggatgacgaaccatctcaccatctctttttttctctctc

SEQ ID NO: 74 - DNA, 2509 bp, Arabidopsis thaliana
  misc_feature: Encoded by SEQ ID NO: 73
  misc_feature (1)..(2509): Ceres CDNA ID no. 12575820
  misc_feature (1)..(2509): Sequence of endogenous gene to Ceres PROMOTER  YP0216
tctctataaatccttatatgttttacttacattcctaaagttttcaactttcttgagcttcaaaaagtacctccaatggcttcttctgcatttgcttttccttcttacataataaccaaaggaggactttcaactgattcttgtaaatcaacttctttgtcttcttctagatctttggttacagatcttccatcaccatgtctgaaacccaacaacaattcccattcaaacagaagagcaaaagtgtgtgcttcacttgcagagaagggtgaatattattcaaacagaccaccaactccattacttgacactattaactacccaatccacatgaaaaatctttctgtcaaggaactgaaacaactttctgatgagctgagatcagacgtgatctttaatgtgtcgaaaaccggtggacatttggggtcaagtcttggtgttgtggagcttactgtggctcttcattacattttcaatactccacaagacaagattctttgggatgttggtcatcagtcttatcctcataagattcttactgggagaagaggaaagatgcctacaatgaggcaaaccaatggtctctctggtttcaccaaacgaggagagagtgaacatgattgctttggtactggacacagctcaaccacaatatctgctggtttaggaatggcggtaggaagggatttgaaggggaagaacaacaatgtggttgctgtgattggtgatggtgcgatgacggcaggacaggcttatgaagccatgaacaacgccggatatctagactctgatatgattgtgattcttaatgacaacaagcaagtctcattacctacagctactttggatggaccaagtccacctgttggtgcattgagcagtgctcttagtcggttacagtctaacccggctctcagagagttgagagaagtcgcaaagggtatgacaaagcaaataggcggaccaatgcatcagttggcggctaaggtagatgagtatgctcgaggaatgataagcgggactggatcgtcactgtttgaagaactcggtctttactatattggtccagttgatgggcacaacatagatgatttggtagccattcttaaagaagttaagagtaccagaaccacaggacctgtacttattcatgtggtgacggagaaaggtcgtggttatccttacgcggagagagctgatgacaaataccatggtgttgtgaaatttgatccagcaacgggtagacagttcaaaactactaataagactcaatcttacacaacttactttgcggaggcattagtcgcagaagcagaggtagacaaagatgtggttgcgattcatgcagccatgggaggtggaaccgggttaaatctctttcaacgtcgcttcccaacaagatgtttcgatgtaggaatagcggaacaacacgcagttacttttgctgcgggtttagcctgtgaaggccttaaacccttctgtgcaatctattcgtctttcatgcagcgtgcttatgaccaggttgtccatgatgttgatttgcaaaaattaccggtgagatttgcaatggatagagctggactcgttggagctgatggtccgacacattgtggagctttcgatgtgacatttatggcttgtcttcctaacatgatagtgatggctccatcagatgaagcagatctctttaacatggttgcaactgctgttgcgattgatgatcgtccttcttgtttccgttaccctagaggtaacggtattggagttgcattacctcccggaaacaaaggtgttccaattgagattgggaaaggtagaattttaaaggaaggagagagagttgcgttgttgggttatggctcagcagttcagagctgtttaggagcggctgtaatgctcgaagaacgcggattaaacgtaactgtagcggatgcacggttttgcaagccattggaccgtgctctcattcgcagcttagctaagtcgcacgaggttctgatcacggttgaagaaggttccattggaggttttggctcgcacgttgttcagtttcttgctctcgatggtcttcttgatggcaaactcaagtggagaccaatggtactgcctgatcgatacattgatcacggtgcaccagctgatcaactagctgaagctggactcatgccatctcacatcgcagcaaccgcacttaacttaatcggtgcaccaagggaagctctgttttgagagtaagaatctgttggctaaaacatatgtatacaaacactctaaatgcaacccaaggtttcttctaagtactgatcagaattcccgccgagaagtcctttggcaacagctatatatatttactaagattgtgaagagaaaggcaaaggcaaaggttgtgcaaagattagtattatgataaaactggtatttgttttgtaattttgtttaggattgtgatggagatcgtgttgtacaataatctaacatcttgtaaaaatcaattacatctctttgtgta

SEQ ID NO: 75 - protein, 717 aa, Arabidopsis thaliana
  misc_feature (1)..(717): Ceres CDNA ID no. 12575820
  misc_feature (1)..(717): Sequence of endogenous gene to Ceres PROMOTER  YP0216
MASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQLAAKVDEYARGMISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 76 - DNA, 999 bp, Arabidopsis thaliana
  misc_feature (1)..(999): Predicted sequence of Ceres PROMOTER  YP0271
atctctgattttttttatcaggaacaagtaaataaatagctttgagtttttgttttttttctacattcttcgcccaaaagatgtaagaaaataaaggatttgaaaccttgttctgttgttactcctttaaattcttaaaaactataaatcattatatctttgatctgtttcacaaactaatcatattcgttgcaaagtgagaattcgtcccactttactctttacaccgatactagtattatagatgtacagcatagtattccatatctagttatttagtcaaaactctatatattaagaggtaggttaattaattaaggagtaattgaagattatagaaagaataaaaaataccatttaatggacagaaccaaagataactaactatcatactataatgttgaatttcttccacgatccaatgcatggataacaacatcaatcaaatcatacattcatgctatataacatagttttcagttacaaactctcttttttatttatttcagttgttccttttcatgaccatattaacatcaaataatgcatttttttcaacgtctcttgacttacacccactaatattgacaaattgaacatctatacgactatacacacataagttaaaaatgcatgcaagtgctaagggaatttataacatctaaggttaataagactaagaaagtataaaataagaatacgtattatgaatttatgatatactttactaatctttttgaaaaatactttaatttaatctactatagggggtaaaaagtaaaaaagaaataaagatacgtttatccgcatatagtacctggaaataacagaaaataaaaacacaggtaagtactttgcctgagctagtatatgaacactaaagagatacacacacacaaaaagagagcagaaacaaaacacacacacttaaagctttcgtctttacctcttcccttctctctctctatctaaaaagagttccgagaagaagatcatcat

SEQ ID NO: 77 - DNA, 984 bp, Arabidopsis thaliana
  misc_feature (1)..(984): Experimental sequence of Ceres PROMOTER  YP0271
atctctgattttttttatcaggaacaagtaaataaatagctttgagtttttgttttttttctacattcttcgcccaaaagatgtaagaaaataaaggatttgaaaccttgttctgttgttactcctttaaattcttagaaactataaatcattatatctttgatctgtttcacaaactaatcatattcgttgcaaagtgagaattcgtcccactttactctttacaccgatactagtattatagatgtacagcatagtattccatatctagttatttagtcaaaactctatatattaagaggtaggttaattaattaaggagtaattgaagattatagaaagaataaaaaataccatttaatggacagaaccaaagataactaactatcatactataatgttgaatttcttccacgatccaatgcatggataacaacatcaatcaaatcatacattcatgctatataacatagttttcagttacaaactctcttttttatttatttcagttgttccttttcatgaccatattaacatcaaataatgcatttttttcaacgtctcttgacttacacccactaatattgacaaattgaacatctatacgactatacgcacataagttaaaaatgcatgcaagtgctaagggaatttataacatctaaggttaataagactaagaaagtataaaataagaatacgtattatgaatttatgatatactttactaatctttttgaaaaatactttaatttaatctactatagggggtaaaaagtaaaaaagaaataaagatacgtttatccgcatatagtacctggaaataacagaaaataaaaacacaggtaagtactttgcctgagctagtatatgaacactaaagagatacacacacacaaaaagagagcagaaacaaaacacacacacttaaagctttcgtctttacctcttcccttctctctctctatctaaaaagagttccga

SEQ ID NO: 78 - DNA, 1273 bp, Arabidopsis thaliana
  misc_feature: Encoded by SEQ ID NO: 77
  misc_feature (1)..(1273): Ceres CDNA ID no. 12658070
  misc_feature (1)..(1273): Sequence of endogenous gene to Ceres PROMOTER  YP0271
cacacttaaagctttcgtctttacctcttcccttctctctctctatctaaaaagagttccgagaagaagatcatcatcaatggcgacttctctcttcttcatgtcaacagatcaaaactccgtcggaaacccaaacgatcttctgagaaacacccgtcttgtcgtcaacagctccggcgagatccggacagagacactgaagagtcgtggtcggaaaccaggatcgaagacaggtcagcaaaaacagaagaaaccaacgttgagaggaatgggtgtagcaaagctcgagcgtcagagaatcgaagaagaaaagaagcaactcgccgccgccacagtcggagacacgtcatcagtagcatcgatctctaacaacgctacccgtttacccgtaccggtagacccgggtgttgtgctacaaggcttcccaagctcactcgggagcaacaggatctattgtggtggagtcgggtcgggtcaggttatgatcgacccggttatttctccatggggttttgttgagacctcctccactactcatgagctctcttcaatctcaaatcctcaaatgtttaacgcttcttccaataatcgctgtgacacttgcttcaagaagaaacgtttggatggtgatcagaataatgtagttcgatccaacggtggtggattttcgaaatacacaatgattcctcctccgatgaacggctacgatcagtatcttcttcaatcagatcatcatcagaggagccaaggtttcctttatgatcatagaatcgctagagcagcttcagtttctgcttctagtactactattaatccttatttcaacgaggcaacaaatcatacgggaccaatggaggaatttgggagctacatggaaggaaaccctagaaatggatcaggaggtgtgaaggagtacgagttttttccggggaaatatggtgaaagagtttcagtggtggctaaaacgtcgtcactcgtaggtgattgcagtcctaataccattgatttgtccttgaagctttaaatgttttatctttctatattgatttaaacaaaatcgtctctttaaagaaaaaacattttaagtagatgaaagtaagaaacagaagaaaaaaaagagagagccttttttggtgtatgcatctgagagctgagtcgaaagaaagattcagcttttggattacccttttggttgtttattatgagattctaacctaaacactcagacatatatgttctgttctcttccttaattgttgtcatgaaacttctc

SEQ ID NO: 79 - protein, 314 aa, Arabidopsis thaliana
  misc_feature (1)..(314): Ceres CDNA ID no. 12658070
  misc_feature (1)..(314): Sequence of endogenous gene to Ceres PROMOTER  YP0271
MATSLFFMSTDQNSVGNPNDLLRNTRLVVNSSGEIRTETLKSRGRKPGSKTGQQKQKKPTLRGMGVAKLERQRIEEEKKQLAAATVGDTSSVASISNNATRLPVPVDPGVVLQGFPSSLGSNRIYCGGVGSGQVMIDPVISPWGFVETSSTTHELSSISNPQMFNASSNNRCDTCFKKKRLDGDQNNVVRSNGGGFSKYTMIPPPMNGYDQYLLQSDHHQRSQGFLYDHRIARAASVSASSTTINPYFNEATNHTGPMEEFGSYMEGNPRNGSGGVKEYEFFPGKYGERVSVVAKTSSLVGDCSPNTIDLSLKL

SEQ ID NO: 80 - DNA, 999 bp, Arabidopsis thaliana
  misc_feature (1)..(999): Predicted sequence of Ceres PROMOTER  YP0279
cgctttattataggtttaacaattgatttttcattattttgttttcaatctccaaatcatttctcaataactctcaaacattgtttaaagctttttttcttaattaacattataacaaaaaaataaatagagaaatttactttgattcaaacaccagtcattgtagattagccaagagttttcagtaacaaaatttaccttataaaccttttgaatggctatttctgaaatggaatagaaatctttagtcgtggaagtatctctatccataagaaaactcgttttacaaagtaattttaaatcaatacaaaaagtgaaaaaatccactggtggaccccattcattccagaattgccgattacgagctatcttgtcccttcttcaccattcgctcactctctctctctctctctcgtcttcttcttcccaccactctctctgtttctccacaacttctcttctcaaagttaaaattacccctaaaccaaaaaaaaaaaaaacgctcttcactatttatttactaaactctcctttgtttgttactaagctctcactaaaaccctaatctttctcctcttatatatctcgtgactcttctttctcctccaatctctctctccctcttcacaaaccaattagcttctttctgtaaaacctcactcgttggccaattcttttggttttcatacacataaatctcagattccaaatgggttttcttagctctttctttcaaatgatgaacatttgttagcagaatcttcctctttccctaaagttttgatctttttttcccccttcaattttgtattttctcaccaaataaaaaaaggtttcttcagtgggttttaagggtttattattatcttaaaattaaacacaattctttaatcaaaaggcaaaaatcttaatttcatcactctcttctcactcacaaaagttcttacaatcttcaaagttttggtcttgtttcttttccgatttcaccggacaaaaaaa

SEQ ID NO: 81 - DNA, 496 bp, Arabidopsis thaliana
  misc_feature (1)..(496): Experimental sequence of Ceres PROMOTER  YP0279
cgctttattataggtttaacaattgatttttcattattttgttttcaatctccaaatcatttctcaataactctcaaacattgtttaaagctttttttcttaattaacattataacaaaaaaataaatagagaaatttactttgattcaaacaccagtcattgtagattagccaagagttttcagtaacaaaatttaccttataaaccttttgaatggctatttctgaaatggaatagaaatctttagtcgtggaagtatctctatccataagaaaactcgttttacaaagtaattttaaatcaatacaaaaaagtgaaaaaatccactggtggaccccattcattccagaattgccgattacgagctatcttgtcccttcttcaccattcgctcactctctctctctctctctcgtcttcttcttcccaccactctctctgtttctccacaacttctcttctcaaagttaaaattacccctaaaccaaaaaaaaa

SEQ ID NO: 82 - DNA, 1544 bp, Arabidopsis thaliana
  misc_feature: Encoded by SEQ ID NO: 81
  misc_feature (1)..(1544): Ceres CDNA ID no. 12600234
  misc_feature (1)..(1544): Sequence of endogenous gene to Ceres PROMOTER  YP0279
atgtcggcgtgtttaagcagcggaggaggaggagcagcagcatatagtttcgagttagaaaaagtgaaatcaccaccaccatcatcctcaacaacaacaacaagagctacttcaccatcatcaacaatctccgaatcatcaaattcaccactcgcaatctcaacgagaaagccaagaacacaacgcaaaagaccaaaccagacttacaacgaagcagctactcttctctctactgcttatcccaacatcttctcctcaaacttgtcctctaagcaaaaaactcactcttcatcaaactctcacttctacgggccattgcttagtgacaacgacgacgcttctgatttgcttcttccttatgaatcaatcgaagaacctgattttctgtttcatccaacgattcaaacgaaaacagagtttttctcagaccagaaggaagttaactccggtggagattgctacggtggtgaaatcgaaaagtttgatttctccgacgaattcgatgctgaatcgattctcgatgaggatattgaagaaggaatcgatagtataatggggactgtggtggaatcgaattcaaattcggggatttatgaatctagggttccgggaatgatcaatcgcggtggaagaagttcttctaatcggattggtaaactagaacagatgatgatgatcaattcatggaatcgaagctctaacggattcaatttcccgttagggcttggattacgaagtgctctcagagaaaacgacgacacaaaattgtggaagattcataccgttgatttcgaacagatctcgccgcgaattcaaactgtcaaaaccgaaactgcaatctccaccgttgatgaggagaaatccgacggtaagaaggtggtaatctctggagagaagagtaataagaagaagaagaagaagaaaatgacggtgacgacgacattgattacggaatcgaaaagcttggaagatacggaggagacgagtttgaagagaacaggtccgttgttgaagcttgattacgacggcgttttggaagcttggtctgataaaacgtcgccgtttcccgacgagattcagggatcggaagctgtcgatgtcaatgctagattagctcagattgatttgttcggagacagtggaatgcgagaagcaagtgttttgaggtacaaagagaaacgtcgaactcgtcttttttcgaagaaaattcgataccaagttcgcaaactcaatgctgatcaacgtcctcgaatgaagggacgattcgtgagaaggcccaatgagagcactccaagtggacaaagataacaaggataaaagagcctagatttatcttatctttttttttttatcttttgtttattccttgttttatttttgtttctaaaattttggcaccctccttttttgtttcttttaagttatggtcccttttggtttataatttagattttttgatgagggggagatttgattgagaaagtgagggatcaaaactaataaaagtttttgttattaatagaagaaacagagctcttgagatt

SEQ ID NO: 83 - protein, 435 aa, Arabidopsis thaliana
  misc_feature (1)..(435): Ceres CDNA ID no. 12600234
  misc_feature (1)..(435): Sequence of endogenous gene to Ceres PROMOTER  YP0279
MSACLSSGGGGAAAYSFELEKVKSPPPSSSTTTTRATSPSSTISESSNSPLAISTRKPRTQRKRPNQTYNEAATLLSTAYPNIFSSNLSSKQKTHSSSNSHFYGPLLSDNDDASDLLLPYESIEEPDFLFHPTIQTKTEFFSDQKEVNSGGDCYGGEIEKFDFSDEFDAESILDEDIEEGIDSIMGTVVESNSNSGIYESRVPGMINRGGRSSSNRIGKLEQMMMINSWNRSSNGFNFPLGLGLRSALRENDDTKLWKIHTVDFEQISPRIQTVKTETAISTVDEEKSDGKKVVISGEKSNKKKKKKKMTVTTTLITESKSLEDTEETSLKRTGPLLKLDYDGVLEAWSDKTSPFPDEIQGSEAVDVNARLAQIDLFGDSGMREASVLRYKEKRRTRLFSKKIRYQVRKLNADQRPRMKGRFVRRPNESTPSGQR

SEQ ID NO: 84 - DNA, 999 bp, Arabidopsis thaliana
  misc_feature (1)..(999): Predicted sequence of Ceres PROMOTER  YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtatgtatgagtttcccaaaggatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgtcacaaaacaaaactcgct

SEQ ID NO: 85 - DNA, 981 bp, Arabidopsis thaliana
  misc_feature (1)..(981): Experimental sequence of Ceres PROMOTER  YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtacgtatgagtttcccaaaagatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgt

SEQ ID NO: 86 - DNA, 1180 bp, Arabidopsis thaliana
  misc_feature: Encoded by SEQ ID NO: 85
  misc_feature (1)..(1180): Ceres CDNA ID no. 13609092
  misc_feature (1)..(1180): Sequence of endogenous gene to Ceres PROMOTER  YP0285
acaaataaatacctttgtttccctcttcttctccttcactcacaacatctcaatttcattctctcttctctctccaatttcacaacaatgggagtcaaaagtttcgttgaaggtgggattgcctctgtaatcgccggttgctctactcaccctctcgatctaatcaaggttcgtcttcagcttcacggtgaagcaccttccaccaccaccgtcactctcctccgtccagctctcgctttccccaattcttctcctgcagctttcctggaaacgacttcttcagtccccaaagtaggaccgatctcactcggaatcaacatagtcaaatcggaaggcgccgccgcgttattctcaggagtctccgctacacttctccgtcagacgttatattccaccaccaggatgggtctatacgaagtgcttaagaacaaatggactgatcctgagtcagggaagttgaatctgagtaggaagatcggtgcagggctagtcgctggtggaatcggagccgccgttggaaatccagctgacgtggcgatggttaggatgcaagctgacgggaggttacctttagcgcaacgtcgtaactacgccggagtaggagacgcaatcaggagcatggttaagggagaaggcgtaacgagcttgtggcgaggctcggcgttgacgattaaccgagcgatgattgtgacggcggctcagctagcgtcttacgatcagttcaaggaagggatattggagaatggtgtgatgaatgatgggctagggactcacgtggtagcgagttttgcggcggggtttgttgcttcggttgcgtctaatccggtggatgtgataaagacgagagtgatgaatatgaaggtgggagcgtacgacggcgcgtgggattgtgcggtgaagacggttaaagcggaaggagccatggctctttataaaggctttgttcctacagtttgtaggcaaggtcctttcactgttgttctcttcgttacgttggagcaagttaggaagctgcttcgagatttttgataccattcttttattgatgatgatgatggcgactatttatattgatttattcatttttgaaatagtgaacacaagaaggaactaggaagagggggattcaatatattttttgttcaagcattgttgttaaatacaattcaattttagtttc

SEQ ID NO: 87 - protein, 313 aa, Arabidopsis thaliana
  misc_feature (1)..(313): Ceres CDNA ID no. 13609092
  misc_feature (1)..(313): Sequence of endogenous gene to Ceres PROMOTER  YP0285
MGVKSFVEGGIASVIAGCSTHPLDLIKVRLQLHGEAPSTTTVTLLRPALAFPNSSPAAFLETTSSVPKVGPISLGINIVKSEGAAALFSGVSATLLRQTLYSTTRMGLYEVLKNKWTDPESGKLNLSRKIGAGLVAGGIGAAVGNPADVAMVRMQADGRLPLAQRRNYAGVGDAIRSMVKGEGVTSLWRGSALTINRAMIVTAAQLASYDQFKEGILENGVMNDGLGTHVVASFAAGFVASVASNPVDVIKTRVMNMKVGAYDGAWDCAVKTVKAEGAMALYKGFVPTVCRQGPFTVVLFVTLEQVRKLLRDF

SEQ ID NO: 88 - DNA, 999 bp, Arabidopsis thaliana
  misc_feature (1)..(999): Predicted sequence of Ceres PROMOTER  YP0080
aagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttaca

SEQ ID NO: 89 - DNA, 982 bp, Arabidopsis thaliana
  misc_feature (1)..(982): Experimental sequence of Ceres PROMOTER  YP0080
aagcggcaatttagtaagaagtattcaatgtatcatttaccaaaagtatatggttttgggaagagttgttagggatgtattctttctaaacagatgatatgacgatgttcttgaaaactaatgttaaagacgggatctctcgcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaaaagaaaacaggaaatcaaatcaaaagataaagagaaggtaaaacaaaaggcaagaagcactaatgtttaatatttatagttttctccattaaagaaaaagcgatgatgtgtgtgttctcatcttttgtgaaagtatatatattgcttttgctcttctcaaaagcaaaagactcatccaacaacaacaacaaaaaaaaacctaaagctcaatccaaaagacgaagaatgcattggatactacaacttctttttcacttttctttcgaatttacaattatgattttcacaatacagtgtattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgttttt

SEQ ID NO: 90 - DNA, 3008 bp, Arabidopsis thaliana
  misc_feature: Encoded by SEQ ID NO: 89
  misc_feature (1)..(3008): Ceres CDNA ID no. 12603755
  misc_feature (1)..(3008): Sequence of endogenous gene to Ceres PROMOTER  YP0080
atttttgtttttatttttctgatgttacaatggcagacaagatcttcactttcttcctaatcttgtcttcgatctctcctctcttatgctcttctttgatctcacctcttaatctctcacttattagacaagcaaatgtccttatctctctaaagcaaagttttgattcctatgatccttctcttgattcatggaacattccaaatttcaactctctatgttcttggactggtgtttcttgtgacaacttgaatcagtctattactcgtctagacctatctaatctcaacatctccggcactatctctccggaaatatctcgtctttcgccgtcacttgtttttcttgacatttcttctaacagtttctccggtgagcttcctaaagagatctatgagctctcaggcctcgaagtgttaaacatctctagcaatgtttttgaaggagagctggagacacgtgggttcagtcaaatgactcagcttgtgactcttgacgcttacgacaacagcttcaacggatcacttcctctgagtctaaccacactcactcgtctcgagcacttagatcttggaggaaactacttcgacggtgagatccctagaagctatggaagtttcttgagtctcaagtttctttctttatctggtaatgatctccgtgggagaatccctaacgagctagcgaacatcacgactttggtacagctttacttaggttactacaacgattaccgcggtgggatacctgcagatttcgggagattgatcaatcttgttcatttggatttagctaattgcagcttgaaaggatcaattcctgcagaattggggaatctcaagaacttggaggttctgtttcttcagaccaatgagcttacaggctctgttcctcgagagttagggaacatgacaagcctcaagactcttgatctctccaacaactttcttgaaggagagattcctctagagctatctggacttcaaaagcttcagttgtttaacctcttcttcaacagactacacggcgagatccctgagttcgtatctgagcttcctgatctgcaaatactcaagctttggcacaacaatttcaccggaaagattccttcgaaactcggatcaaacgggaacttgatcgagatcgatttgtctaccaataaactcacaggtttgatccctgagtcactctgtttcggaagaagactaaagattctcattctcttcaacaacttcttgttcggtcctctccctgaagatcttggccaatgtgaaccgctatggagattccgtctcggacagaactttctgacaagtaagttgccaaagggtttgatttatttgccgaatctttcgcttcttgagcttcaaaacaactttttgactggagaaatccccgaagaagaggcgggaaatgcgcagttttcgagccttactcagatcaatctgtccaacaacaggttatccggaccgattcctggttcaatcagaaacctcagaagccttcagattcttcttctcggtgcaaaccggttatcgggacagatccctggcgaaatcggaagtttgaagagtcttctcaagattgacatgagcagaaacaacttctcaggcaagtttcctcctgagtttggtgattgcatgtcactcacatatttagatttgagtcacaaccagatttccggtcagattccggttcagatatcgcagattcggattctaaactatctgaatgtttcttggaattcctttaaccaaagccttcccaacgaactcggatacatgaagagtttaacatcagcagatttctcacacaacaacttctccggttcagtaccaacttcagggcaattctcttacttcaacaacacgtcattccttggaaacccttttctctgtggattttcttcaaacccttgcaacggttcccaaaaccaatctcaatctcagctacttaaccagaacaacgcaagatcccgaggtgaaatctccgcaaaattcaagttgttcttcgggttaggcctactagggtttttcttggtgttcgtcgttttagctgtggtcaagaataggagaatgagaaagaacaacccgaatttatggaagcttatagggtttcagaagctcggtttcagaagcgaacacatattagaatgtgttaaagagaaccatgtgattgggaaaggcggacgagggattgtctacaaaggggtaatgccaaacggagaagaagttgcagtcaagaagctcttaaccataaccaaaggatcatctcatgacaacggtttagccgcagagattcagacattaggtagaatcagacacagaaacatagtgagattgctcgctttttgttcaaacaaagacgtgaatctccttgtttacgagtatatgcctaatggtagcctcggagaagtcttgcacgggaaagctggagtgtttttgaaatgggaaacacggttgcaaatagcgttggaagcggctaaggggttgtgttatcttcaccatgattgctcgccacttataatccaccgtgatgtgaagtcaaacaacatcttgttgggtcctgagtttgaagctcatgttgctgattttgggcttgctaagtttatgatgcaagacaatggagcttccgagtgcatgtcctcgatcgctggctcgtacggctacatcgctccagaatatgcatatacactgagaatagacgagaagagcgatgtgtacagcttcggagtagtgttattggagctgattacgggtcgaaaaccagtagataattttggggaagaagggatagacattgtgcaatggtcaaagatccaaacaaactgtaacagacaaggtgtggtgaagatcattgaccagagattgagcaatattccattagcagaggccatggaactgttctttgtggcaatgctatgtgtgcaagaacatagtgttgagagaccgaccatgagagaggttgtccagatgatctctcaggctaaacagcctaatactttctaa

SEQ ID NO: 91 - protein, 992 aa, Arabidopsis thaliana
  misc_feature (1)..(992): Ceres CDNA ID no. 12603755
  misc_feature (1)..(992): Sequence of endogenous gene to Ceres PROMOTER  YP0080
MADKIFTFFLILSSISPLLCSSLISPLNLSLIRQANVLISLKQSFDSYDPSLDSWNIPNFNSLCSWTGVSCDNLNQSITRLDLSNLNISGTISPEISRLSPSLVFLDISSNSFSGELPKEIYELSGLEVLNISSNVFEGELETRGFSQMTQLVTLDAYDNSFNGSLPLSLTTLTRLEHLDLGGNYFDGEIPRSYGSFLSLKFLSLSGNDLRGRIPNELANITTLVQLYLGYYNDYRGGIPADFGRLINLVHLDLANCSLKGSIPAELGNLKNLEVLFLQTNELTGSVPRELGNMTSLKTLDLSNNFLEGEIPLELSGLQKLQLFNLFFNRLHGEIPEFVSELPDLQILKLWHNNFTGKIPSKLGSNGNLIEIDLSTNKLTGLIPESLCFGRRLKILILFNNFLFGPLPEDLGQCEPLWRFRLGQNFLTSKLPKGLIYLPNLSLLELQNNFLTGEIPEEEAGNAQFSSLTQINLSNNRLSGPIPGSIRNLRSLQILLLGANRLSGQIPGEIGSLKSLLKIDMSRNNFSGKFPPEFGDCMSLTYLDLSHNQISGQIPVQISQIRILNYLNVSWNSFNQSLPNELGYMKSLTSADFSHNNFSGSVPTSGQFSYFNNTSFLGNPFLCGFSSNPCNGSQNQSQSQLLNQNNARSRGEISAKFKLFFGLGLLGFFLVFVVLAVVKNRRMRKNNPNLWKLIGFQKLGFRSEHILECVKENHVIGKGGRGIVYKGVMPNGEEVAVKKLLTITKGSSHDNGLAAEIQTLGRIRHRNIVRLLAFCSNKDVNLLVYEYMPNGSLGEVLHGKAGVFLKWETRLQIALEAAKGLCYLHHDCSPLIIHRDVKSNNILLGPEFEAHVADFGLAKFMMQDNGASECMSSIAGSYGYIAPEYAYTLRIDEKSDVYSFGVVLLELITGRKPVDNFGEEGIDIVQWSKIQTNCNRQGVVKIIDQRLSNIPLAEAMELFFVAMLCVQEHSVERPTMREVVQMISQAKQPNTF

SEQ ID NO: 92 - DNA, 999 bp, Arabidopsis thaliana
  misc_feature (1)..(999): Predicted sequence of Ceres PROMOTER  YP0122
agtttaattatttgttatctatccaatcaattttttttctaaactgtttggaccaatgtacgtacgtaccatcctttttgattttttttgtaaactaaattttcgaattagcaggttcttaataattgaacgaagaaaataaagaatagaggtagacacctgtagtattttcttggtcagaccaataatttataattcaacgtcaaagaagaagaaaaatataaaccattatttcattatgacttacgtataccaaaatacacaaattaaatgtataattgtgaggcattttatatgcgggaaaaaataaaataaaaagaatattaatatttcttttgaaaattgtaaagcattttgacccacttgtgatatatatatatatatagatatatatagagagagagattaaaacattgatggctagctatagagtctatggcagggtcatgatcacctgtcttctgatctctgaagagataccaatctgattttttctcttcctaggtttaattttattttaccattttataattctttatttttgcctgtagtacaatttacagacccatactaaaagaaaaattaaattttgtcaaagtacaaaacaaagagagaggtgaagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagac

SEQ ID NO: 93 - DNA, 377 bp, Arabidopsis thaliana
  misc_feature (1)..(377): Experimental sequence of Ceres PROMOTER  YP0122
agtttaattatttgttatctatccaatcaatttttttttctaaactgtttggaccaatgtacgtacgtaccatcctttttgattttttttgtaaactaaattttcggattagcaggttcttaataattgaacgaagaaaataaagaatagaggtagacacctgtagtattttcttggtcagaccaataatttataattcaacgtcaaagaagaagaaaaatataaaccattatttcattatgacttacgtataccaaaatacacaaattaaatgtataattgtgaggcattttatatgcgggaaaaaataaaataaaaagaatattaatatttcttttgaaaattgtaaagcattttgacccacttgtgatatatat

SEQ ID NO: 94 - DNA, 2454 bp, Arabidopsis thaliana
  misc_feature: Encoded by SEQ ID NO: 93
  misc_feature (1)..(2454): Ceres CDNA ID no. 13593439
  misc_feature (1)..(2454): Sequence of endogenous gene to Ceres PROMOTER  YP0122
aagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagacatggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccatatccgagcgatgttgataagcatatattggcccgacaaactggtttatcaagaagtcaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttgagattaaaagattaggaccaaagttatcgatacatattttccaaaaccgattcggttatgtaacggtttagttagataaaaaccaaattagatatttatatataccgttgtctgattggattggaggattggtggacaaggagatattattaatgtatgagttagttggttcgtcaatatcacttgtaggatattttcattttgttttttaaaatatattattgagaggtttttttctc

SEQ ID NO: 95 - protein, 611 aa, Arabidopsis thaliana
  misc_feature (1)..(611): Ceres CDNA ID no. 13593439
  misc_feature (1)..(611): Sequence of endogenous gene to Ceres PROMOTER  YP0122
MARDQFYGHNNHHHQEQQHQMINQIQGFDETNQNPTDHHHYNHQIFGSNSNMGMMIDFSKQQQIRMTSGSDHHHHHHQTSGGTDQNQLLEDSSSAMRLCNVNNDFPSEVNDERPPQRPSQGLSLSLSSSNPTSISLQSFELRPQQQQQQGYSGNKSTQHQNLQHTQMMMMMMNSHHQNNNNNNHQHHNHHQFQIGSSKYLSPAQELLSEFCSLGVKESDEEVMMMKHKKKQKGKQQEEWDTSHHSNNDQHDQSATTSSKKHVPPLHSLEFMELQKRKAKLLSMLEELKRRYGHYREQMRVAAAAFEAAVGLGGAEIYTALASRAMSRHFRCLKDGLVGQIQATSQALGEREEDNRAVSIAARGETPRLRLLDQALRQQKSYRQMTLVDAHPWRPQRGLPERAVTTLRAWLFEHFLHPYPSDVDKHILARQTGLSRSQVSNWFINARVRLWKPMIEEMYCEETRSEQMEITNPMMIDTKPDPDQLIRVEPESLSSIVTNPTSKSGHNSTHGTMSLGSTFDFSLYGNQAVTYAGEGGPRGDVSLTLGLQRNDGNGGVSLALSPVTAQGGQLFYGRDHIEEGPVQYSASMLDDDQVQNLPYRNLMGAQLLHDIV

SEQ ID NO: 96 - DNA, 915 bp, Arabidopsis thaliana
  misc_feature (1)..(915): Predicted sequence of Ceres PROMOTER  YP0049
acatcaatttgcctgcttgtagggtgattcgtcaaatctattatcaggttttaaatatactcgaattgacttccaaattcttagtctctagtgtaatgattttgagaatcacttaactccaaaaatataatccacgatcccgtgttaattattgaagaatcaatcgtttttaatttctcaccaatagatgttgctcttattacttaaaacaaattgtttagacaaatgtagcaagtgtgatacttagtgggatcttaaagacgatttctcctataacagaggacaaacaggtcggtcaattacaatgtcatccctctttaccctgtctttttttttcttcttaaaacctaaccatttgattgtttctaaaggtatttcaagaatatatgatcaatctagatgaatactataccgacgatgactacacacacaaggaaatatatatatcagctttcttttcacctaaaagtggtcccggtttagaatctaattcctttatctctcattttcttctgcttcacattcccgctagtcaaatgttaataagtgcacacaacgttttctcgaagcattagaatgtcctcctcttaattaatctccttctgattagattctcaatagagtttaaatttgttaatggagagatatattgggaccctcaaggcttctaattataccacgtttggcataattctctatcgtttggggccacatctttcacacttcattaccttatcaccaaaacataaaatcaatcaacttttttttgccttattgattgtgttggatccctccaaaattaaaacttgtgttccccacaaaagcttacccaatttcacttcaatcttaacaaataggaccaccactaccacgtacggtttgcatcatacaaaccacaaactccttcttcattac

SEQ ID NO: 97 - DNA, 992 bp, Arabidopsis thaliana
  misc_feature (1)..(992): Experimental sequence of Ceres PROMOTER  YP0049
ttccaaattcttatggttctctagtgtcatgattttgagaatcactcaactccaaaaatataatccacgatcccgtgttaattattgaagaatcaatcgtttttaatttctcaccaatagatgttgctcttattacttaaaacaaattgttcggacaaatgtagcaagtgtgatactttgtgggatcttaaagacgatttctcctataacagaggacaaaacaggtcggtcaattacaatgtcatccctctttgccctgtctttttttttcttcttaaaacctaaccatttgattgtttctaaaggtatttcaagaatatatgatcaatctagatgaatactataccgacgatgactacacacacaaggaaatatatatatcagctttcttttcacctaaaagtggtcccggtttagaatctaattcctttatctctcattttcttctgcttcacattcccgctagtcaaatgttaataagtgcacacaacgttttctcgaagcattagaatgtcctcctcttaattaatctccttctgattagattctcaatagagtttaaatttgttaatggagagatatattgggaccctcaaggcttctaattataccacgtttggcataattctctatcgtttggggccacatctttcacacttcattaccttatcaccaaaacataaaatcaatcaacttttttttgccttattgattgtgttggatccctccaaaattaaaacttgtgttccccacaaaagcttacccaatttcacttcaatcttaacaaataggaccaccactaccacgtacggtttgcatcatacaaaccacaaactccttcttcattacaattattatatcatctactaaaacctctttctccctctctctttcttgttcttagtgctaaattttctttgttcaggagaaatatccattgcactgggatccaacaatgtcatccgactcgtccaagatcaagaggaaagcgg

SEQ ID NO: 98 - DNA, 3168 bp, Arabidopsis thaliana
  misc_feature: Encoded by SEQ ID NO: 97
  misc_feature (1)..(3168): Ceres CDNA ID no. 12660077
  misc_feature (1)..(3168): Sequence of endogenous gene to Ceres PROMOTER  YP0049
tctagatgaatactataccgacgatgactacacacacaaggaaatatatatatcagctttcttttcacctaaaagtggtcccggtttagaatctaattcctttatctctcattttcttctgcttcacattcccgctagtcaaatgttaataagtgcacacaacgttttctcgaagcattagaatgtcctcctcttaattaatctccttctgattagattctcaatagagtttaaatttgttaatggagagatatattgggaccctcaaggcttctaattataccacgtttggcataattctctatcgtttggggccacatctttcacacttcattaccttatcaccaaaacataaaatcaatcaacttttttttgccttattgattgtgttggatccctccaaaattaaaacttgtgttccccacaaaagcttacccaatttcacttcaatcttaacaaataggaccaccactaccacgtacggtttgcatcatacaaaccacaaactccttcttcattacaattattatatcatctactaaaacctctttctccctctctctttcttgttcttagtgctaaattttctttgttcaggagaaatataatggacctcaagtattcagcatctcattgcaacttatcctcagacatgaagctcaggcgttttcatcagcatcgaggaaaaggaagagaagaagagtatgatgcttcttctctcagcttgaacaatctgtcaaaacttattcttcctccacttggtgttgctagctataaccagaatcacatcaggtctagtggatggatcatctcacctatggactcaagatacaggtgctgggaattttatatggtgcttttagtggcatactctgcgtgggtttacccttttgaagttgcatttctgaattcatcaccaaagagaaacctttgtatcgcggacaacatcgtagacttgttcttcgcggttgacattgtcttgacgtttttcgttgcttacatagacgaaagaacacagcttcttgtccgtgaacctaaacagattgcagtgaggtacctatcaacatggttcttgatggatgttgcatcaactataccatttgacgctattggatacttaatcactggcacatccacgttaaatatcacttgtaatctcttgggattacttagattttggcgacttcgaagagttaaacacctcttcactaggctcgagaaggacataagatatagctatttctggattcgctgctttcgacttctatcagtgacattgtttctagtgcactgtgctggatgcagttattacctaatagcagacagatatccacaccaaggaaagacatggactgatgcgatccctaatttcacagagacaagtctttccatcagatacattgcagctatatattggtctatcactacaatgaccacagtgggatatggagatcttcatgcaagcaacactattgaaatggtattcataacagtctacatgttattcaatcttggcctcactgcttaccttattggtaacatgactaatttggtcgtggaagggactcgtcgtaccatggaatttaggaatagcattgaagcagcgtcaaactttgttaacagaaacagattgcctcctagattaaaagaccagatattagcttacatgtgtttaaggtttaaagcagagagcttaaatcagcaacatcttattgaccagctcccaaaatctatctacaaaagcatttgtcaacatctttttcttccatctgttgaaaaagtttacctcttcaaaggcgtctcaagagaaatacttcttcttctggtttcaaaaatgaaggctgagtatataccaccaagagaggatgtcattatgcagaacgaagcgccggatgatgtttacataattgtgtcaggagaagttgagatcattgattcagagatggagagagagtctgttttaggcactctacgttgtggagacatatttggagaagttggagcactttgttgcagaccacaaagctacacttttcaaactaagtctttatcacagcttctccgactcaaaacatctttccttattgagacaatgcagattaaacaacaagacaatgccacaatgctcaagaacttcttgcagcatcacaaaaagctgagtaatttagacattggtgatctaaaggcacaacaaaatggcgaaaacaccgatgttgttcctcctaacattgcctcaaatctcatcgctgtggtgactacaggcaatgcagctcttcttgatgagctacttaaggctaagttaagccctgacattacagattccaaaggaaaaactccattgcatgtagcagcttctagaggatatgaagattgtgttttagtactcttaaagcacggttgcaacatccacataagagatgtgaatggtaatagtgctctatgggaagcaataatatcgaagcattacgagatattcagaatcctttatcatttcgcagccatatcggatccacacatagctggagatcttctatgtgaagcagcgaaacagaacaatgtagaagtcatgaaggctcttttaaaacaggggcttaacgtcgacacagaggatcaccatggcgtcacagctttacaggtcgctatggcggaggatcagatggacatggtgaatctcctggcgacgaacggtgcagatgtagtttgtgtgaatacacataatgaattcacaccattggagaagttaagagttgtggaagaagaagaagaagaagaacgaggaagagtgagtatttacagaggacatccattggagaggagagaaagaagttgcaatgaagctgggaagcttattcttcttcctccttcacttgatgacctcaagaaaattgcaggagagaagtttgggtttgatggaagtgagacgatggtgacgaatgaagatggagctgagattgacagtattgaagtgattagagataatgacaaactctactttgtcgtaaacaagataatttagaagttgaaaaattataacgaaatgaagtttgagataagagagagcgtgacaaaaaaatgaaaaacaaattgtaatatttatatgcgtccatcaaagtgagatgtaacacatatttgggtaagaaacgttccaaatccctgacgtagctcgag

SEQ ID NO: 99 - protein, 802 aa, Arabidopsis thaliana
  misc_feature (1)..(802): Ceres CDNA ID no. 12660077
  misc_feature (1)..(802): Sequence of endogenous gene to Ceres PROMOTER  YP0049
MDLKYSASHCNLSSDMKLRRFHQHRGKGREEEYDASSLSLNNLSKLILPPLGVASYNQNHIRSSGWIISPMDSRYRCWEFYMVLLVAYSAWVYPFEVAFLNSSPKRNLCIADNIVDLFFAVDIVLTFFVAYIDERTQLLVREPKQIAVRYLSTWFLMDVASTIPFDAIGYLITGTSTLNITCNLLGLLRFWRLRRVKHLFTRLEKDIRYSYFWIRCFRLLSVTLFLVHCAGCSYYLIADRYPHQGKTWTDAIPNFTETSLSIRYIAAIYWSITTMTTVGYGDLHASNTIEMVFITVYMLFNLGLTAYLIGNMTNLVVEGTRRTMEFRNSIEAASNFVNRNRLPPRLKDQILAYMCLRFKAESLNQQHLIDQLPKSIYKSICQHLFLPSVEKVYLFKGVSREILLLLVSKMKAEYIPPREDVIMQNEAPDDVYIIVSGEVEIIDSEMERESVLGTLRCGDIFGEVGALCCRPQSYTFQTKSLSQLLRLKTSFLIETMQIKQQDNATMLKNFLQHHKKLSNLDIGDLKAQQNGENTDVVPPNIASNLIAVVTTGNAALLDELLKAKLSPDITDSKGKTPLHVAASRGYEDCVLVLLKHGCNIHIRDVNGNSALWEAIISKHYEIFRILYHFAAISDPHIAGDLLCEAAKQNNVEVMKALLKQGLNVDTEDHHGVTALQVAMAEDQMDMVNLLATNGADVVCVNTHNEFTPLEKLRVVEEEEEEERGRVSIYRGHPLERRERSCNEAGKLILLPPSLDDLKKIAGEKFGFDGSETMVTNEDGAEIDSIEVIRDNDKLYFVVNKII

SEQ ID NO: 100 - DNA, 999 bp, Arabidopsis thaliana
  misc_feature (1)..(999): Predicted sequence of Ceres PROMOTER  YP0015
ttgagccttattgttgttattgacttttagccaatagaaagagatggaaattcaataattatccacaaaattccaaatcattggtgtacaaaaagatctaaggctgttatattttcaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctcttaaccaccttccacata

SEQ ID NO: 101 - DNA, 984 bp, Arabidopsis thaliana
  misc_feature (1)..(984): Experimental sequence of Ceres PROMOTER  YP0015
ttgagccttattgttgttattgacttttagccaatagaaagagatggaaattcaataattatccacaaaattccaaatcattggtgtacaaaaagatctaaggctgttatatttccaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctctta

SEQ ID NO: 102 - DNA, 962 bp, Arabidopsis thaliana
  misc_feature: Encoded by SEQ ID NO: 101
  misc_feature (1)..(962): Ceres CDNA ID no. 13612380
  misc_feature (1)..(962): Sequence of endogenous gene to Ceres PROMOTER  YP0015
aaaaaagttcagatatttgataaatcaatcaacaaaacaaaaaaaactctatagttagtttctctgaaaatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatccataaacaaaatagacactttaataaagccgtgagtgttaatttttc

SEQ ID NO: 103 - protein, 243 aa, Arabidopsis thaliana
  misc_feature (1)..(243): Ceres CDNA ID no. 13612380
  misc_feature (1)..(243): Sequence of endogenous gene to Ceres PROMOTER  YP0015
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 104 - DNA, 999 bp, Arabidopsis thaliana
  misc_feature (1)..(999): Predicted sequence of Ceres PROMOTER  YP0230
ataaaattatctataaatcattaaatctttgatgagaaatatccaatctactaatgtatatcgatgatttaaatgaaattacttatttgaacacaaaaataaatgaatttactaataaataaatagcgtagttggagcaagtggctaaaaaaattacaaatctagtttccattctcagcgtcggctgcttggaacgtcaccgttttctggaaaacgcaatcttctcccttccgtgacgtctcaccggaattttctcgcttttgtctactctcctccatctccgaggttctccaagctcagctcctcttcccatcattcatccgaccgccttatccggtcagatcctttacgtatttctattttcctgatcgtcgatttttgagaaatgtaaaaacagatcgtataaggcctcgaagtttttaatttgaaagtggtatcgaaattttttggtctttgattaggttagggcaccgtagctctgggtattgaatttgtagggttttcctctggttattggtctttggagcttggtaatttctgctgaattgattgatcccttttccatcttttgaagtaaagtctcgagctttcgtgtctcgatgtagatgaattctattttgaatatgagatttgataagacgtcaattgctgataatttggagtctttgtgtctgaatttgttcatatgaagttttctgagggatgtgaattttattgtctgctaattttgaaacgttccttttggaatttggtttgtgaggagtcctagatctttttctgtgaagtttcttgcttgtaagttttctggatcacttgattgagtctagaatctagatagattacatgtacggtttgattcctttggctgattttccaaagttttgttcaaatttcaggagaactacaaagaggaaaccaagattgttttgttttgttagactctaccccttttccgattcacatggtaaggacattgaggtagagaataatactaaaaag

SEQ ID NO: 105 - DNA, 970 bp, Arabidopsis thaliana
  misc_feature (1)..(970): Experimental sequence of Ceres PROMOTER  YP0230
aatcattaaatctttgatgagaaatatccaatctactaatgtatatcgatgatttaaatgaaattacttatttgaacacaaaaataaatgaatttactaataaataaatagcgtagttgcgagcaagtggctaaaaaaattacaaatctagtttccattctcagcggcggggtgcttggaacgtcaccgttttttggaaaacgcaatcttcctcccttccgggacgtctcaccggaattttctcgcttttgtctactctcctccatctccgaggttctccaagctcagctcctcttcccatcattcatccgaccgccttatccggtcagatcctttacgtatttctattttcctgatcgtcgatttttgagaaatgtaaaaacagatcgtataaggcctcgaagtttttaatttgaaagtggtatcgaaattttttggtctttgattaggttagggcaccgtagctctgggtattgaatttgtagggttttcctctggttattggtctttggagcttggtaatttctgctgaattgattgatcccttttccatcttttgaagtaaagtctcgagctttcgtgtctcgatgtagatgaattctattttgaatatgagatttgataagacgtcaattgctgataatttggagtctttgtgtctgaatttgttcatatgaagttttctgagggatgtgaattttattgtctgctaattttgaaacgttccttttggaatttggtttgtgaggagtcctagatctttttctgttaagtttcttgcttgtaagttttctggatcacttgattgagtctagaatctagatagattacatgttcggtttgattcctttggctgattttccaaagttttgttcaaatttcaggagaactacaaagaggaaaccaagatggttttgttttgttagactctaccccttttccgattcacatggtaaggacattgaggtag

SEQ ID NO: 106 - DNA, 519 bp, Arabidopsis thaliana
  misc_feature: Encoded by SEQ ID NO: 105
  misc_feature (1)..(519): Ceres CDNA ID no. 12676237
  misc_feature (1)..(519): Sequence of endogenous gene to Ceres PROMOTER  YP0230
cgaaggcacgacaagcatcaatccgcctcaagcagtagcagcaggaaacgtagcagggaacatggcaggagctcatggaatgggcagtagatcgatgccaagaccaatggttgcacataacatgcagaggatgcagcaatctcaaggcatgatggcttataatttcccggcacaggcagggcttaacccgagtgttccgctgcagcagcagcgcgggatggctcaaccgcaccagcagcaacagctaagaaggaaagatcccggaatgggtatgtcaggttacgcacctcctaacaaatccagacgcctctaaaggtaaaatcgagatcatcagtctcgggttagaatctgtgtgtttgccgcagaagaaagcgttgcgatttgctttatagagtagagttagattgtaatgcagcatgtggaatgttgctattcatatggatggattggattctctgtagtttttgtataaacatcctctcaagtatttgttaattatattagatcatcatttctctt

SEQ ID NO: 107 - protein, 103 aa, Arabidopsis thaliana
  misc_feature (1)..(103): Ceres CDNA ID no. 12676237
  misc_feature (1)..(103): Sequence of endogenous gene to Ceres PROMOTER  YP0230
EGTTSINPPQAVAAGNVAGNMAGAHGMGSRSMPRPMVAHNMQRMQQSQGMMAYNFPAQAGLNPSVPLQQQRGMAQPHQQQQLRRKDPGMGMSGYAPPNKSRRL

SEQ ID NO: 108 - DNA, 999 bp, Arabidopsis thaliana
  misc_feature (1)..(999): Predicted sequence of Ceres PROMOTER  YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataaaaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcattttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcatctagagttactactatggagacaaaagtcgaataaaagagacctcacgtgaaaatgttacgagctagtaactaaagcatttacactaacggtaaaaaaagtatctataaatgtttacacaaggtagtagtcatt

SEQ ID NO: 109 - DNA, 476 bp, Arabidopsis thaliana
  misc_feature (1)..(476): Experimental sequence of Ceres PROMOTER  YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttca

SEQ ID NO: 110 - DNA, 929 bp, Arabidopsis thaliana
  misc_feature: Encoded by SEQ ID NO: 109
  misc_feature (1)..(929): Ceres CDNA ID no. 12370095
  misc_feature (1)..(929): Sequence of endogenous gene to Ceres PROMOTER  YP0120
agcactcaacttaaactcttttagtaacaatggtttcttcttctttaaccaagcttgtgttctttggttgtctcctcctgctcacattcacggacaaccttgtggctggaaaatctggcaaagtgaagctcaatctttactacgaatcactttgtcccggttgtcaggaattcatcgtcgatgacctaggtaaaatctttgactacgatctctacacaatcactgatctcaagctgtttccatttggtaatgccgaactctccgataatctgactgtcacttgccagcatggtgaagaggaatgcaaactaaacgcccttgaagcttgcgcattaagaacttggcccgatcagaaatcacaatactcgttcatacggtgcgtcgaaagcgatacgaaaggctgggaatcatgtgttaaaaactctggacgtgagaaagcaatcaatgattgttacaatggtgatctttctagaaagctgatacttgggtacgcaaccaaaaccaagaatttgaagccgccacatgaatacgtaccatgggtcacactcaacggcaagccactcgatgacagcgtacaaagtacggatgatctcgtagctcaaatctgcaatgcatacaaaggaaagactactctcccaaaagtttgcaattcatccgcctcaatgtctaagtcgcctgagaggaaatggaagcttcaagtctcttatgccaataaagctaccaattattaagttaactatcaaacttcgtattgaactaagatggatttaagctttatgttataagtggaatgatgaataaaggcctgttctaaacttttatggttacgaattgatgtattaaaaaagaacatgaaaaacgcctgaactgaactacaagtattttatatgacgtcttatcgacgaaagtgttatgtaactcggtttatc

SEQ ID NO: 111 - protein, 233 aa, Arabidopsis thaliana
  misc_feature (1)..(233): Ceres CDNA ID no. 12370095
  misc_feature (1)..(233): Sequence of endogenous gene to Ceres PROMOTER  YP0120
MVSSSLTKLVFFGCLLLLTFTDNLVAGKSGKVKLNLYYESLCPGCQEFIVDDLGKIFDYDLYTITDLKLFPFGNAELSDNLTVTCQHGEEECKLNALEACALRTWPDQKSQYSFIRCVESDTKGWESCVKNSGREKAINDCYNGDLSRKLILGYATKTKNLKPPHEYVPWVTLNGKPLDDSVQSTDDLVAQICNAYKGKTTLPKVCNSSASMSKSPERKWKLQVSYANKATNY

SEQ ID NO: 112 - DNA, 1000 bp, Arabidopsis thaliana
  misc_feature (1)..(1000): Predicted sequence of Ceres PROMOTER  YP0060
tggagctttattgaaatgcaagaaagtaaacaaaggaagatctttagattgtcaccaagagtggtctgaaactctcataacactcaatcctcctcctcctcatcaccaccactacaaaatattatattctctatctctcaatctatgaggagatgtattctatcaagcatttgaaatgataagaaactggcgatcatcctctacgtcaccatcactccaaaattatcctctttctaggtttaagttttgtaatgatcgcctttatttgttgagatctctaacttctcgcatttccaaaatgttaagtccaataactgcattggttaagttggggcgttactagtcggcttaaatccaaatatggatttgattccatatgtatgtgacagtttcttaacgttcatattacaatgaatgatggatccttgactagacaaagagaaaatggattgtcacttcgtaggaaaaatagaaattctccacgaaggctggtctcctttatttaacgacaaattcactcatagtctcattcacaatttgaacttgtctaacacaatgtgttatatactcgcgaaaagaagcataataggctcttaagggtaatccacgaaaccaaaacacatataaaacattaatatttttctctaaatttattcatatcaataataaagtttacaaaaaatataaaacaataatccatacttagcccatagcttcgtgtggaagaagacttgatttttgactagtcaacgaaaatgagtaaatgacgtattcagctatagtaaaagggatcataagcggaaattacaaagaagctttgagggtaaaatagtcaaaaagcataatcagaaataacttaggcccaaagcaaaaaggaaaggactctggatccagccgcaaatcagaatctggtaagttcgaacgccacgtcatcacctaaatatctgaaatatctaattaagacttgtctatatataaaggcttctcctttcacaatccc

SEQ ID NO: 113 - DNA, 469 bp, Arabidopsis thaliana
  misc_feature (1)..(469): Experimental sequence of Ceres PROMOTER  YP0060
tggagctttattgaaatgcaagaaagtaaacaaaggaagatctttagattgtcaccaagagtggtctgaaactctcataacactcaatcctcctcctcctcatcaccaccactacaaaatattatattctctatctctcaatctatgaggagatgtattctatcaagcatttgaaatgataagaaactggcgatcatcctctacgtcaccatcactccaaaattatcctctttctaggtttaagttttgtaatgatcgcctttatttgttgagatctctaacttctcgcatttccaaaatgttaagtccaataactgcattggttaagttggggcgttactagtcggcttaaatccaaatatggatttgattccatatgtatgtgacagtttcttaacgttcatattacaatgaatgatggatccttgactagacaaagagaaaatggattgtcacttcgtaggaaaaa

SEQ ID NO: 114 - DNA, 1383 bp, Arabidopsis thaliana
  misc_feature: Encoded by SEQ ID NO: 113
  misc_feature (1)..(1383): Ceres CDNA ID no. 13613553
  misc_feature (1)..(1383): Sequence of endogenous gene to Ceres PROMOTER  YP0060
aaacctttctcttctctgctaacgagaaaacaaaagctatcgtctttgctactactactactactattattacattgaatcctttgtgttcttcttcttcagctgctactttgttcgagtgctttcttacatgccgtcggagattgttgacaggaaaaggaagtctcgtggaacacgagatgtagctgagattctaaggcaatggagagagtacaatgagcagattgaggcagaatcttgtatcgatggtggtggtccaaaatcaatccgaaagcctcctccaaaaggttcgaggaagggttgtatgaaaggtaaaggtggacctgaaaacgggatttgtgactatagaggagttagacagaggagatggggtaaatgggttgctgagatccgtgagccagacggaggtgctaggttgtggctcggtactttctccagttcatatgaagctgcattggcttatgacgaggcggccaaagctatatatggtcagtctgccagactcaatcttcccgagatcacaaatcgctcttcttcgactgctgccactgccactgtgtcaggctcggttactgcattttctgatgaatctgaagtttgtgcacgtgaggatacaaatgcaagttcaggttttggtcaggtgaaactagaggattgtagcgatgaatatgttctcttagatagttctcagtgtattaaagaggagctgaaaggaaaagaggaagtgagggaagaacataacttggctgttggttttggaattggacaggactcgaaaagggagactttggatgcttggttgatgggaaatggcaatgaacaagaaccattggagtttggtgtggatgaaacgtttgatattaatgagctattgggtatattaaacgacaacaatgtgtctggtcaagagacaatgcagtatcaagtggatagacacccaaatttcagttaccaaacgcagtttccaaattctaacttgctcgggagcctcaaccctatggagattgctcaaccaggagttgattatggatgtccttatgtgcagcccagtgatatggagaactatggtattgatttagaccatcgcaggttcaatgatcttgacatacaggacttggattttggaggagacaaagatgttcatggatctacataagatttcaaatttcgtttgactggcctaagtttgtgattctgctccgagacggtgtagctgttactagctagaagctgcccttctttgaagctactgatactttctgatattaatggttgtgagacgtagtacatgtagttaggtaatgtaggacaagttcaaatatgattccttctttctttttcttgtgaatacatatgacatatgaagaagttcaaacgttgggt

SEQ ID NO: 115 - protein, 341 aa, Arabidopsis thaliana
  misc_feature (1)..(341): Ceres CDNA ID no. 13613553
  misc_feature (1)..(341): Sequence of endogenous gene to Ceres PROMOTER  YP0060
MPSEIVDRKRKSRGTRDVAEILRQWREYNEQIEAESCIDGGGPKSIRKPPPKGSRKGCMKGKGGPENGICDYRGVRQRRWGKWVAEIREPDGGARLWLGTFSSSYEAALAYDEAAKAIYGQSARLNLPEITNRSSSTAATATVSGSVTAFSDESEVCAREDTNASSGFGQVKLEDCSDEYVLLDSSQCIKEELKGKEEVREEHNLAVGFGIGQDSKRETLDAWLMGNGNEQEPLEFGVDETFDINELLGILNDNNVSGQETMQYQVDRHPNFSYQTQFPNSNLLGSLNPMEIAQPGVDYGCPYVQPSDMENYGIDLDHRRFNDLDIQDLDFGGDKDVHGST

SEQ ID NO: 116 - DNA, 998 bp, Arabidopsis thaliana
  misc_feature (1)..(998): Predicted sequence of Ceres PROMOTER  YP0261
  misc_feature (489)..(489): n is a, c, t, g, unknown, or other
gtcgattggttgtaaattagttttatcgtagaagtaccaaatcaagtgattcaatggttaaattaaggtattaagttacatttgatatttaaaagtatccagaccttcattatagctcataagggttaaaattttgtcgttcttttgtatattcatggcaagctctaattcatgactaagtcacatttttcaaatatgtttttagtttttacttatgttggtaattagtggatttatagttaagttaaaaagttggcgagttctagctttgaaactcatttagaaatatatatatatatatatatattcaattttagtaaattgttaatctattctaatggtgtaactgtaacaaatgagaatgaaaaaaatatactattgtgaataaaaccccacacaacacattactataataagttaaacttctttttttataggcgcctggaaaaaaaagaaaagcaacaagagggstgtgaggacgcatcaccnggtttcgtagcacacatgtgcatttgtctctttgctttttcggtttttttcttgccaatcaatttattttgttcctcagaaaaaagaaaatctaaaaccaaaatatatattataacctcatttaataaacaacaaaaatgtttgttgaaaaaaaaaaagtttttatttatcttgaccttatttctttgaagaaaataaagcttggttattaaagaagtccaagttagttgccaccatcagtggcataacggtaaattaaagccaacttcctctaactaaagttttctataaattcaaccactcacctcccactctaaaacccaacaacataatttcacatatctctctttctttctcttgaaggaaagacgaagatctccaagtcccaagtacgtaactactttctccatctacattcaattgtttctccttaatttctctagtacatatttacttgtgctataagtaattgattttatatcacccatgtgcaggttgttaacacaaga

SEQ ID NO: 117 - DNA, 298 bp, Arabidopsis thaliana
  misc_feature (1)..(298): Experimental sequence of Ceres PROMOTER  YP0261
ttgtaaattagttttatcgtagaagtaccaaatcaagtgattcaatggttaaattaaggtattaagttacatttgatatttaaaagtatccagaccttcattatagctcataagggttaaaattttgtcgttcttttgtatattcatggcaagctctaattcatgactaagtcacatttttcaaatatgtttttagtttttacttatgttggtaattagtggatttatagttaagttaaaaagttggcgagttctagctttgaaactcatttagaaatatatatatatatatatatat

SEQ ID NO: 118 - DNA, 1244 bp, Arabidopsis thaliana
  misc_feature: Encoded by SEQ ID NO: 117
  misc_feature (1)..(1244): Ceres CDNA ID no. 12385291
  misc_feature (1)..(1244): Sequence of endogenous gene to Ceres PROMOTER  YP0261
aaacccaacaacataatttcacatatctctctttctttctcttgaaggaaagacgaagatctccaagtcccaagttgttaacacaagacgtaaacatgggtcatcttgggttcttagttatgattatggtaggagtcatggcttcttctgtgagcggctacggtggcggttggatcaacgctcacgccactttttacggtggtggtgatgcttccggcacaatgggtggtgcttgtggatatggtaatctatatagccaaggctacgggacgagcacggcggctctaagcacagctctcttcaacaatggacttagctgtggttcttgctttgagataagatgtgaaaacgatggtaaatggtgtttacctggctcaatcgttgtaaccgctacaaacttctgcccgccaaataacgcgttagcgaacaataatggcggttggtgtaatcctcctcttgaacactttgaccttgctcagcctgtttttcaacgcattgctcagtacagagctggaatcgtccctgtttcctacagaagggttccttgcaggagaagaggaggaataagattcacgataaacggccactcatacttcaaccttgtgctgatcacaaacgtcggtggtgccggagacgttcactcggcggcgatcaagggttcaagaacagtgtggcaagctatgtcaaggaactgggggcaaaattggcaaagcaactcttacctcaacggtcaagcactttcctttaaggtcaccaccagcgacggccgcacagttgtctccttcaacgccgctcctgccggctggtcttatggccagacttttgccggtggacagttccgttaaaaagggcaagttggttaatctctcttccatttatctaaagtaaactcatttgtgtggttatattggtctcttgaaaaaactcggttattgagagagtgatgcgtcgagggctcggttttgcagaaggccttgatgacgtctaatctttttttggacctctttatttttctttcttgaaactagtttttgttaagaaagaaaaaacaagttatagtagttaatgtattactgatgcagaggtggagttttaactaccacccgctagtagtagttatgagttttttattttaaggtgtgagagagagatggattatcaagatttgtcaattttattatgtttgtttgtaataatacaattctttactccagttaatgaaaattgggggattgatcactttt

SEQ ID NO: 119 - protein, 249 aa, Arabidopsis thaliana
  misc_feature (1)..(249): Ceres CDNA ID no. 12385291
  misc_feature (1)..(249): Sequence of endogenous gene to Ceres PROMOTER  YP0261
MGHLGFLVMIMVGVMASSVSGYGGGWINAHATFYGGGDASGTMGGACGYGNLYSQGYGTSTAALSTALFNNGLSCGSCFEIRCENDGKWCLPGSIVVTATNFCPPNNALANNNGGWCNPPLEHFDLAQPVFQRIAQYRAGIVPVSYRRVPCRRRGGIRFTINGHSYFNLVLITNVGGAGDVHSAAIKGSRTVWQAMSRNWGQNWQSNSYLNGQALSFKVTTSDGRTVVSFNAAPAGWSYGQTFAGGQFR

SEQ ID NO: 120 - DNA, 999 bp, Arabidopsis thaliana
  misc_feature (1)..(999): Predicted sequence of Ceres PROMOTER  YP0263
tattatatatacgattaaataaataaaaaaattgtaatgtgaaaatatcatagtcgagaggggaactgacaagtgtacatatgtatctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaacgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcatgctagcatttttcattttcccttcatttgtggataacgcacgatataacattctacacaccaacaagattctataaaaacgcaaaggttgtctccatagaatatcgtc

SEQ ID NO: 121 - DNA, 311 bp, Arabidopsis thaliana
  misc_feature (1)..(311): Experimental sequence of Ceres PROMOTER  YP0263
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaa

SEQ ID NO: 122 - DNA, 1308 bp, Arabidopsis thaliana
  misc_feature: Encoded by SEQ ID NO: 121
  misc_feature (1)..(1308): Ceres CDNA ID no. 12640578
  misc_feature (1)..(1308): Sequence of endogenous gene to Ceres PROMOTER  YP0263
gtcccatcaccaaacattaagtagcactctttttcctctctatatctctcactcacactttttctctatatcttctcctcaacttggatatgggtgaagccgtagaggtcatgttcggaaatgggttcccggagattcacaaagccacatcacccactcaaaccctccactctaaccagcaagactgccattggtatgaagaaaccatcgatgatgatctcaagtggtcttttgccctcaacagtgttctccatcaaggaactagtgagtaccaagatattgctctgttggacaccaaacgttttggaaaggtgcttgtgattgatgggaaaatgcaaagtgctgagagagatgagtttatctaccatgaatgtttgatccatcccgctctccttttccatcccaaccccaagactgtgtttataatgggaggaggtgaaggctctgctgcaagagaaatactaaaacacacgacgatcgagaaagttgttatgtgtgatattgatcaggaagttgttgatttttgcagaagatttctgaccgttaacagcgatgctttctgtaacaaaaagcttgaacttgtgatcaaagatgcaaaggctgaattagagaaaagggaagagaagtttgatatcatagtgggagatttagctgatccagtggaaggtggaccttgttatcagctctacaccaaatccttctaccaaaacattctcaaacccaagcttagccctaatggcatttttgtcacccaggctggaccagcaggaatattcactcataaggaagtcttcacatcaatctacaacaccatgaagcaagtcttcaagtacgtgaaggcttacacagcacatgtgccatcatttgcggacacatggggatgggtgatggcatcggaccacgagtttgacgttgaagttgatgaaatggatcgaagaatcgaagagagagttaacggagaattgatgtatctaaacgctccttctttcgtctctgctgctactctcaacaaaaccatctctctcgcgctagagaaggagactgaagtttatagtgaagagaatgcgagattcattcatggtcatggtgtggcgtaccggcatatttaaagacgaaccggtttcagtttcagtgttattaccaaacccatgtcacaaaaacaaaaggccggtttcttttctccgcacagaaccgggtgttgtcttgaatcttgattactttggttcggttttattttctacattgctttttgttttcttgttcttccctcaagttattccggtttaacaagactatattgcttactaa

SEQ ID NO: 123 - protein, 339 aa, Arabidopsis thaliana
  misc_feature (1)..(339): Ceres CDNA ID no. 12640578
  misc_feature (1)..(339): Sequence of endogenous gene to Ceres PROMOTER  YP0263
MGEAVEVMFGNGFPEIHKATSPTQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVNGELMYLNAPSFVSAATLNKTISLALEKETEVYSEENARFIHGHGVAYRHI

SEQ ID NO: 124 - DNA, 882 bp, Arabidopsis thaliana
  misc_feature (1)..(882): Predicted sequence of Ceres PROMOTER  YP0003
tggatctgctagatatatgagaacggaaagaaccagaagctattagaggcgggaggagatatgtggggatgatttcagtgcaattccacgacgcaccatttccactttcgtaacacctaaacgaccgcttcggccgtataaaatcgcaaatgtttggtctcagtgtatttttccaatttccaaatacatcaattcaaattatataatatctagtggcaattataagtatatcatatattttcaaaattaattaaaaagattactaaattatgtttgactacaactattataatagttaaaaacataaacaaaaacaaagaaactattttaataaaaaaatcaagtaaacattaaaacataagcaaaaaataatgttaaagaaattattaattattaatttactaataattaatacctctataaattaattgttagaggtttaacgtaatttataaggaaaactaaagaagactttaacccataaagaaaaaaacaaagactgaattgaaggcccatatttagaagaagagaaagaagacccaaatatgatataaaatccagcccatttatatatttttattttgtttctggaaggaaaataagaaaatggcaaaaacgaaataatctgaaaaagtaaggtcttttaccaaaaaggatattttttttataaacagagcataaagttttcacttttcttctgctcctttctcgtctctgtcttcttcgtcctcattcgttttaaagcatcaaaatttcatcaacccaaaatagattaaaaaaatctgtagctttcgcatgtaaatctctctttgaaggttcctaactcgttaatcgtaactcacagtgactcgttcgagtcaaagtctctgtctttagctcaaa

SEQ ID NO: 125 - DNA, 25 bp, Arabidopsis thaliana
  misc_feature (1)..(25): Experimental sequence of Ceres PROMOTER  YP0003
tggatctgctagatatatgagaacg

SEQ ID NO: 126 - DNA, 1537 bp, Arabidopsis thaliana
  misc_feature: Encoded by SEQ ID NO: 125
  misc_feature (1)..(1537): Ceres CDNA ID no. 12649228
  misc_feature (1)..(1537): Sequence of endogenous gene to Ceres PROMOTER  YP0003
gctcctttctcgtctctgtcttcttcgtcctcattcgttttaaagcatcaaaatttcatcaacccaaaatagattaaaaaaatctgtagctttcgcatgtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgagccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcacccacttgaaaggtaaaaaagtgaaaaaggctttgtagatggaatcaatgtaggatttgcagtagagggaaaaaaaatgtcaaaaagctcaattgatcaagtattattgtaatcattgtacctttattttaggtggactttgatgaaagcaactttttgttttcaagactttagtgggaggttgaggaaggagcttgaagggtgttatttattagtagtagtagtagtgggaagttgtgggaccttgttgagttgtgttcaaattgaagaaaaaacaagtatttgtaatttgtcaccccttgtattattatttattttgtatga

SEQ ID NO: 127 - protein, 310 aa, Arabidopsis thaliana
  misc_feature (1)..(310): Ceres CDNA ID no. 12649228
  misc_feature (1)..(310): Sequence of endogenous gene to Ceres PROMOTER  YP0003
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMSRLGGAGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 128 - DNA, 1000 bp, Arabidopsis thaliana
  misc_feature (1)..(1000): Predicted sequence of Ceres PROMOTER  YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagcccagacataacaaaattagacttgtcgtacatctttaatattttttttatctgtttctttgtcctgacgctttcattattcctgtgatcaattttctcataccattggtccatcgttaatcctttctcaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagt

SEQ ID NO: 129 - DNA, 432 bp, Arabidopsis thaliana
  misc_feature (1)..(432): Experimental sequence of Ceres PROMOTER  YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaactt

SEQ ID NO: 130 - DNA, 2841 bp, Arabidopsis thaliana
  misc_feature: Encoded by SEQ ID NO: 129
  misc_feature (1)..(2841): Ceres CDNA ID no. 12661844
  misc_feature (1)..(2841): Sequence of endogenous gene to Ceres PROMOTER  YP0092
atggccgaggatttggacaagccattgctggatcctgatactttcaacagaaaaggaattgatttgggtatattgccgttggaggaggtttttgaatacctaagaacatcgcctcaagggcttttatctggagatgctgaagagagattgaagatatttggtcctaacagacttgaagagaaacaggagaacagatttgtgaaattcttaggttttatgtggaatcccttgtcatgggttatggaagctgctgcattgatggccattgccctcgctaatagtcaaagtctaggtcctgactgggaagactttactggaatcgtttgccttttgctgatcaacgcaacaatcagcttctttgaagaaaacaatgctgggaatgctgctgcagctcttatggctcgcttggctttaaaaacaagagttcttagagatggacagtggcaagaacaagatgcttctatcttggtacctggtgatataattagcattaagcttggggatatcattcctgcagatgctcgccttcttgaaggagaccccttgaagattgatcagtcagtgctgaccggagaatcactacctgtgaccaagaagaagggtgaacaggtcttttctggctctacttgtaaacaaggtgaaatagaagctgttgtgatagcaactggatcgaccaccttctttggaaaaacagcacgcttggtggacagtacagatgtaactggacattttcagcaggttcttacatcgattggaaacttctgcatttgctccattgctgttggaatggttcttgaaatcattatcatgttccctgtacaacatcgctcttacagaattgggatcaataatcttcttgtactactgattggagggatacccattgccatgcccactgtactatctgtaacgcttgccattggatctcatcgactttcacaacagggtgccattacgaaaagaatgaccgcaatagaggaaatggctgggatggatgtactctgctgtgataaaactggaacccttactttgaacagtcttaccgttgataaaaatcttattgaggtattcgttgactacatggacaaggatacaattttgttgcttgcaggccgagcttcacgactagaaaatcaggatgctatagatgcagccattgttagcatgcttgcagatcccagagaggcacgtgcaaacattagagaaatccatttcttaccattcaatcctgtggacaaacgtactgcaataacgtatattgattccgatggaaaatggtatcgtgctaccaaaggtgctcctgaacaggttctaaacttgtgtcagcagaaaaatgagattgcgcaaagagtttatgccatcattgatagatttgcagaaaaaggtttgaggtctcttgcggttgcttatcaggaaattccagagaaaagcaacaacagtcctggaggaccatggaggttctgtggtctgttgccactgtttgatcccccaaggcatgatagcggtgaaaccatccttagagctcttagcctgggagtttgcgttaagatgatcactggtgatcaattggcgattgcaaaggagacaggcagacgtcttggaatgggaaccaacatgtatccttcttcctctttgttaggccacaacaatgatgagcatgaagccattccagtggatgagctaattgaaatggcagatggatttgctggagttttccctgaacataagtatgagattgtaaagattttacaagaaatgaagcatgtggttggaatgaccggagatggtgtgaatgatgctcctgctctcaaaaaagctgacatcggaatagctgtcgcagatgcaacagatgctgcaagaagttctgctgacatagtactaactgatcccggcttaagtgtaattatcagtgctgtcttgaccagcagagccattttccagcggatgaggaactatacagtatatgcagtctctatcaccatacgcatacttggttttacacttttagcgttgatatgggaatacgacttcccacctttcatggttctgataatcgcaatactcaatgacgggactatcatgactatttctaaagatcgagttaggccatctcctacacccgagagttggaagctcaaccagatatttgcgacaggaattgtcattggaacatatctagcattggtcaccgtcctgttttactggatcattgtttctaccaccttcttcgagaaacacttccatgtaaaatcaattgccaacaacagtgaacaagtgtcatccgcgatgtatctccaagtgagcatcatcagtcaggcactcatatttgtaacacgtagtcgaggctggtcattttttgaacgtcccgggactctcctgatttttgccttcattcttgctcaacttgcggctacattaattgctgtgtatgccaacatcagctttgctaaaatcaccggcattggatggagatgggcaggtgttatatggttatacagtctgatattttacatacctctagatgttataaagtttgtctttcactacgcattgagtggagaagcttggaatctcgtattggaccgtaagacagcttttacttacaagaaagattatgggaaagatgatggatcgcccaatgtaaccatctctcagagaagtcgttccgcagaagaactcagaggaagccgttctcgcgcttcttggatcgctgaacaaaccaggaggcgtgcagaaatcgccaggcttctagaggttcattcagtgtcaaggcatttagaatctgtgatcaaactcaaacaaattgaccaaaggatgatccgtgcagctcatactgtctaa

SEQ ID NO: 131 - protein, 946 aa, Arabidopsis thaliana
  misc_feature (1)..(946): Ceres CDNA ID no. 12661844
  misc_feature (1)..(946): Sequence of endogenous gene to Ceres PROMOTER  YP0092
MAEDLDKPLLDPDTFNRKGIDLGILPLEEVFEYLRTSPQGLLSGDAEERLKIFGPNRLEEKQENRFVKFLGFMWNPLSWVMEAAALMAIALANSQSLGPDWEDFTGIVCLLLINATISFFEENNAGNAAAALMARLALKTRVLRDGQWQEQDASILVPGDIISIKLGDIIPADARLLEGDPLKIDQSVLTGESLPVTKKKGEQVFSGSTCKQGEIEAVVIATGSTTFFGKTARLVDSTDVTGHFQQVLTSIGNFCICSIAVGMVLEIIIMFPVQHRSYRIGINNLLVLLIGGIPIAMPTVLSVTLAIGSHRLSQQGAITKRMTAIEEMAGMDVLCCDKTGTLTLNSLTVDKNLIEVFVDYMDKDTILLLAGRASRLENQDAIDAAIVSMLADPREARANIREIHFLPFNPVDKRTAITYIDSDGKWYRATKGAPEQVLNLCQQKNEIAQRVYAIIDRFAEKGLRSLAVAYQEIPEKSNNSPGGPWRFCGLLPLFDPPRHDSGETILRALSLGVCVKMITGDQLAIAKETGRRLGMGTNMYPSSSLLGHNNDEHEAIPVDELIEMADGFAGVFPEHKYEIVKILQEMKHVVGMTGDGVNDAPALKKADIGIAVADATDAARSSADIVLTDPGLSVIISAVLTSRAIFQRMRNYTVYAVSITIRILGFTLLALIWEYDFPPFMVLIIAILNDGTIMTISKDRVRPSPTPESWKLNQIFATGIVIGTYLALVTVLFYWIIVSTTFFEKHFHVKSIANNSEQVSSAMYLQVSIISQALIFVTRSRGWSFFERPGTLLIFAFILAQLAATLIAVYANISFAKITGIGWRWAGVIWLYSLIFYIPLDVIKFVFHYALSGEAWNLVLDRKTAFTYKKDYGKDDGSPNVTISQRSRSAEELRGSRSRASWIAEQTRRRAEIARLLEVHSVSRHLESVIKLKQIDQRMIRAAHTV

SEQ ID NO: 132 - DNA, 1000 bp, Arabidopsis thaliana
  misc_feature (1)..(1000): Predicted sequence of Ceres PROMOTER  YP0113
tatgaagaaattataatagactctcataaaaatagtgttacaacttacattctcttatatagaaattaggataaacagaaatgtaaataatatatttcgaaataatgttaaatttcctaaattctaatattaatatttataaatggtcatttaactttttcgtaccggttcgatgggacatgtgttatattcagttaaggttaccaccatgcgccaacttggcctctaccaagtcaacatggatatggaccttatggttacatgccgcctccgcctccaccgctaccgggatatggatacagaggtccgccacctcagcaaccgacgaggaatgaaacaaggcaataatatattgatgctattgtggatttagttactgataattagtgccttagtgacagttcaaaaatgttgttcatcaataatctacaatttaaggtttgtgttgtggaatgtttcatgattttatgaagtcttgcttatcaaaaagtatgatgattaagaatttgacttcatggcatattcatttgagttagcaaaacttttttgtgttgcaccttcaaatttataaatttatgatttttaaccatcgaaattatatatttgaaaagactatctctacaagccaaacccactgggccaccaatatgggtttatctgcgaaatctgtgaaccttagaaaatcaaagcccatatccactttgctggaactttgctggaatgtaggttagacaaaaccttaagacgcagctacaagtctcttatgtggcagatgtcaaaattaatgagcacgtataatttacccaagaggagcaaaataagattagcagcttaaattaattgtgttggattaaatgaaacttgcactatgaatggcaaaaaagaggttacaatctagcaaccacctcataaaccctcattaatgagatactgactcgtgaaccaatcaaatctcaagtttcgtagtttaaataagtagtaaacacctcctgatcaaagc

SEQ ID NO: 133 - DNA, 1117 bp, Arabidopsis thaliana
  misc_feature (1)..(1117): Experimental sequence of Ceres PROMOTER  YP0113
tatgaagaaattataatagactctcataaaaatagtgttacaacttacattctcttatatagaaattaggataaacagaaatgtaaataatatatttcgaaataatgttaaatttcctaaattctaatattaatatttataaatggtcatttaactttttcgtaccggttcgatgggacatgtgttatattcagttaaggttaccaccatgcgccaacttggcctctaccaagtcaacatggatatggaccttatggttacatgccgcctccgcctccaccgctaccgggatatggatacagaggtccgccacctcagcaaccgacgaggaatgaaacaaggcaataatatattgatgctattgtggatttagttactgataattagtgccttagtgacagttcaaaaatgttgttcatcaataatctacaatttaaggtttgtgttgtggaatgtttcatgattttatgaagtcttgcttatcaaaaagtatgatgattaagaatttgacttcatggcatattcatttgagttagcaaaacttttttgtgttgcaccttcaaatttataaatttatgatttttaaccatcgaaattatatatttgaaaagactatctctacaagccaaacccactgggccaccaatatgggtttatctgcgaaatctgtgaaccttagaaaatcaaagcccatatccactttgctggaactttgctggaatgtaggttagacaaaaccttaagacgcagctacaagtctcttatgtggcagatgtcaaaattaatgagcacgtataatttacccaagaggagcaaaataagattagcagcttaaattaattgtgttggattaaatgaaacttgcactatgaatggcaaaaaagaggttacaatctagcaaccacctcataaaccctcattaatgagatactgactcgtgaaccaatcaaatctcaagtttcgtagtttaaataagtagtaaacacctcctgatcaaagcatcaccaccaccaaatatcaaacgcaaaaacctattatcaaaagaactagggaggaaatgactaatccccatgatcatggttatgctgttgttgtttcttgtgatgtcgactagagc

SEQ ID NO: 134 - DNA, 718 bp, Arabidopsis thaliana
  misc_feature: Encoded by SEQ ID NO: 133
  misc_feature (1)..(718): Ceres CDNA ID no. 12332135
  misc_feature (1)..(718): Sequence of endogenous gene to Ceres PROMOTER  YP0113
atcaccaccaccaaatatcaaacgcaaaaacctattatcaaaagaactagggagaaatgactaatcccatgatcatggttatgctgttgttgtttcttgtgatgtcgactagagcagacgaagagctgattaagacagagtgtaatcacacagaataccaaaacgtatgcctcttctgtcttgaagccgatccaatctccttcaatatcgaccgtgctggacttgtcaacatcattatacactgtctcggatctcaacttgatgttcttatcaacaccgtcacgagtctaaagttgatgaaaggagagggtgaagcaaatgagaatgttctgaaagattgcgtcacaggctttgcgattgcacaattacgacttcaaggagccaacatcgatttgataacccttaattacgataaagcgtacgaattggtgaaaactgcgttaaactatcctcggacttgcgaagaaaatctccaaaaactcaagttcaaagattcatctgatgtttatgacgatatcttggcatatagccaactcacctctgttgctaagacgttgatccaccgtctctagatcaatatatatgtcgatctggttatcaaaaatatatttatgtcgatcgtttgctaccactaataaaataaaactccattatgtatgtcacgcgtgatttaatttcactcatcaacaaataaaataaaataaaataaaatgtttag

SEQ ID NO: 135 - protein, 171 aa, Arabidopsis thaliana
  misc_feature (1)..(171): Ceres CDNA ID no. 12332135
  misc_feature (1)..(171): Sequence of endogenous gene to Ceres PROMOTER  YP0113
MTNPMIMVMLLLFLVMSTRADEELIKTECNHTEYQNVCLFCLEADPISFNIDRAGLVNIIIHCLGSQLDVLINTVTSLKLMKGEGEANENVLKDCVTGFAIAQLRLQGANIDLITLNYDKAYELVKTALNYPRTCEENLQKLKFKDSSDVYDDILAYSQLTSVAKTLIHRL

SEQ ID NO: 136 - DNA, 999 bp, Arabidopsis thaliana
  misc_feature (1)..(999): Predicted sequence of Ceres PROMOTER  YP0095
ttcctcgaccatgccgttgccggaaccggctagcgcggccggccggcggcggcggggaggccgcagtgggacgacgggtgaaggatcctccagctgcggaaggaggtggtcctcgaggccgaaggggagaggctacggagatggagggaagccgaagagaagggaggctgctgctgctgctgcatttgggagacgagaactcgactcgagccatggcggcagattggtgtttcacggcggaatgctaactagatccagcatctccatagcaaaggtagaatggtagattgaggtgagttttttttcccctcttctgcagttttgatgtattattactgccctcatctgatctgggtaacatatttctgagctcagtagaactgttaaaaaaaggcagaaatgcacaaactcttctcacaaaacaacatacaaatgcttatattttggagcggaggcaatacatggtatattttttaaagtgaaaaaaacaatcagacacatggtattgagtgatagcaaagctgggtgaccacagaaaatacctcctgctttaaatactttatacctgggctgtcaatcctcggagttcctcccaatgtaatgtctgaggaagaagtattgcagctaaattttaagggtttcttgtacgaaacagggacaatcagagattaagaaactctatgtggaaaaggccatgcgcattttgttatgtgattcaacaaataagatgaggaggcaaagtcatggttctgttctaattaacaaatctactatgggggccgttgctccctattgtccacgctccttttcttcatttctctcctgcaggatatcttgtcttttgattcttcattttaggtcttataaatatcacgtggttcaggcctccaatgtcaaattatcattacgtggaactctcttagatgcttgagaaaagttagctcttacctgtccatagaagctccaaggaagcgagaatagtagatactttggttggcc

SEQ ID NO: 137 - DNA, 999 bp, Arabidopsis thaliana; identical to SEQ ID NO: 136
  misc_feature (1)..(999): Experimental sequence of Ceres PROMOTER  YP0095

SEQ ID NO: 138 - DNA, 1467 bp, Arabidopsis thaliana
  misc_feature: Encoded by SEQ ID NO: 137
  misc_feature (1)..(1467): Ceres CDNA ID no. 6795099
  misc_feature (1)..(1467): Sequence of endogenous gene to Ceres PROMOTER  YP0095
atggccactggtgtttctgttgagaacataaaccccaaggttatactagggccatcatcgatcgctgagtgcatagtcattcgtggagaggttgccatccatgctcagcacctacaacagcagctacagacacaacctggttctcttccatttgatgagatcgtgtattgcaacatcgggaaccctcagtccttgggtcaaaaaccaatcacattcttcagggaggttcttgcactttgcaatcatccaaatctgctggagagagaggaaattaaatcattgttcagcactgatgctattgctcgggcaaagaaaattctttccatgattcctggaagagccaccggggcatatagtcatagccagggtatcaagggactgcgtgatgagattgctgctgggattgcctcccgtgatggtttccctgcaaatgcagatgatatattcctaactaatggagcaagtcctggtgtacacatgatgatgcagttgctgataaggaacaacagagatggcattatgtgtccaattcctcaatactcattgtactcagcatccctagcacttcatggcggagctcttgtgccatattatcttgatgaatcctcaggatggggtttggaggtttctaagcttaagaatcaacttgaagatgccaggtcaaaaggcataactgttagggcgttggtggtgatcaatcctggaaatcctactggacagattcttgatgagcaacagcaatatgagctagtaaagttctgcaaggacgaggaacttgttcttctggcggatgaggtataccaagagaacatttatgttaccaacaagaagatcaactctttcaagaagatagcaagatccatgggatacaatggagacgatttacaattagtatcattgcattctgtttctaaaggatattacggagagtgtggcaagagaggcggttacatggaggtcactggcttcagcactccagttagagaacaactctacaaaattgcatctgttaacttgtgttcaaatatcaccggccagatccttgcgagcctcataatggatccaccaaaggctggggacgcatcttatgacctctacgaggaagagaaagacaacatcctaaaatctttatctcgtcgtgcaaaggcaatggagtctgcatttaacagtattgatggaattacatgcaacaagacggaaggggcgatgtatctgttcccacggatttatctaccacagaaggcaattgaggctgccagggctgtcaacaaagcacctgatgtattctacgctctacgtcttcttgataccaccggcatcgttgtgactcctggatctggttttggacaagttgcagggacatggcacgtgagatgcacgatcctgccgcaggaggagaagataccttcgatgatctcccgcttcagggaattccatgaggagttcatgtcacagtatcgcgactga

SEQ ID NO: 139 - protein, 488 aa, Arabidopsis thaliana
  misc_feature (1)..(488): Ceres CDNA ID no. 6795099
  misc_feature (1)..(488): Sequence of endogenous gene to Ceres PROMOTER  YP0095
MATGVSVENINPKVILGPSSIAECIVIRGEVAIHAQHLQQQLQTQPGSLPFDEIVYCNIGNPQSLGQKPITFFREVLALCNHPNLLEREEIKSLFSTDAIARAKKILSMIPGRATGAYSHSQGIKGLRDEIAAGIASRDGFPANADDIFLTNGASPGVHMMMQLLIRNNRDGIMCPIPQYSLYSASLALHGGALVPYYLDESSGWGLEVSKLKNQLEDARSKGITVRALVVINPGNPTGQILDEQQQYELVKFCKDEELVLLADEVYQENIYVTNKKINSFKKIARSMGYNGDDLQLVSLHSVSKGYYGECGKRGGYMEVTGFSTPVREQLYKIASVNLCSNITGQILASLIMDPPKAGDASYDLYEEEKDNILKSLSRRAKAMESAFNSIDGITCNKTEGAMYLFPRIYLPQKAIEAARAVNKAPDVFYALRLLDTTGIVVTPGSGFGQVAGTWHVRCTILPQEEKIPSMISRFREFHEEFMSQYRD

SEQ ID NO: 140 - DNA, 1000 bp, Arabidopsis thaliana
  misc_feature (1)..(1000): Predicted sequence of Ceres PROMOTER  YP0102
atttggttgataacgttttcactcgactaattatatacttcagaaggatagtaatagaataccaaaataattaaatgattggttagtgccttagtggagactttttaaccgattctaatagactaatgatgtagctaagcatttatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcagatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaacat

SEQ ID NO: 141 - DNA, 1000 bp, Arabidopsis thaliana; identical to SEQ ID NO: 140
  misc_feature (1)..(1000): Experimental sequence of Ceres PROMOTER  YP0102

SEQ ID NO: 142 - DNA, 1124 bp, Arabidopsis thaliana
  misc_feature: Encoded by SEQ ID NO: 141
  misc_feature (1)..(1124): Ceres CDNA ID no. 13613954
  misc_feature (1)..(1124): Sequence of endogenous gene to Ceres PROMOTER  YP0102
aatcacacaaatcccttttttggtttctccaaatcttcaaatcttcttcaatcatcaccatggtacgttttagtaacagtcttgtaggaatactcaacttcttcgtcttccttctctcggttcccatactctcaaccggaatctggctcagccttaaagccacgacgcaatgcgagagattcctcgacaaacccatgatcgctctcggtgttttcctcatgataatcgcaatcgctggagtcgttggatcttgttgcagagtgacgtggcttctctggtcctatctctttgtgatgttcttcttaatcctcatcgtcctctgtttcaccatctttgccttcgttgtcactagtaaaggctccggcgaaactatccaaggaaaagcttataaggagtataggctcgaggcttactctgattggttgcagaggcgtgtgaacaacgctaagcattggaacagcattagaagctgtctttatgagagcaagttctgttataacttggagttagtcactgctaatcacactgtttctgatttctacaaagaagatctcactgcttttgagtctggttgctgcaagccctctaatgactgtgacttcacctacataacttcaacaacttggaataaaacatcaggaacacataaaaactcagattgccaactttgggacaacgaaaagcataagctttgctacaattgcaaagcctgcaaggccggttttctcgacaacctcaaggccgcatggaaaagagttgctattgtcaacatcattttccttgtactcctcgttgtcgtctacgctatgggatgttgcgctttccgaaacaacaaagaagatagatatggccgttccaatggtttcaacaattcttgatttgcgccggttcaagctagactttgatttttcattaatacatcatattacatttatgattagaacaaaacagctttcaaaatttaagaaacagtagaatggaagaatattgaattagtatagttgttgatgtgtttggatttcttctgttgatttgtgtttggacaacagaggattcttcagatctttattacagattgttgtgtttgaagaatcttctatatgaatcttcacttctgacttctg

SEQ ID NO: 143 - protein, 272 aa, Arabidopsis thaliana
  misc_feature (1)..(272): Ceres CDNA ID no. 13613954
  misc_feature (1)..(272): Sequence of endogenous gene to Ceres PROMOTER  YP0102
MVRFSNSLVGILNFFVFLLSVPILSTGIWLSLKATTQCERFLDKPMIALGVFLMIIAIAGVVGSCCRVTWLLWSYLFVMFFLILIVLCFTIFAFVVTSKGSGETIQGKAYKEYRLEAYSDWLQRRVNNAKHWNSIRSCLYESKFCYNLELVTANHTVSDFYKEDLTAFESGCCKPSNDCDFTYITSTTWNKTSGTHKNSDCQLWDNEKHKLCYNCKACKAGFLDNLKAAWKRVAIVNIIFLVLLVVVYAMGCCAFRNNKEDRYGRSNGFNNS

SEQ ID NO: 144 - DNA, 1001 bp, Arabidopsis thaliana
  misc_feature (1)..(1001): Predicted sequence of Ceres PROMOTER  YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcatgttgagttggataagtcaactgtcttcttttcttttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgttttacaccatgcacgtgttatctaacaaagaaaatatggtacacctaatggctaatgcaaaggacaacacaatgaaactaacttgactctgtgttatacaaacccatagacatctgcatacatcctagtatttgtataaattggactcaaattcctgaggacaatcatagcaaacaatcacatcatcgcaatatacataaacaaaagaggaagaaaaa

SEQ ID NO: 145 - DNA, 541 bp, Arabidopsis thaliana
  misc_feature (1)..(541): Experimental sequence of Ceres PROMOTER  YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaacc

SEQ ID NO: 146 - DNA, 434 bp, Arabidopsis thaliana
  misc_feature: Encoded by SEQ ID NO: 145
  misc_feature (1)..(434): Ceres CDNA ID no. 4905097
  misc_feature (1)..(434): Sequence of endogenous gene to Ceres PROMOTER  YP0103
atagcaaacaatcacatcatcgcaatatacataaacaaaagaggaagaaaaatggcaaccgagtggtgtagttatattgggaagaactcatggccggagcttttaggaacaaatggagactatgcggcttcggtgataaaaggagagaactcgagcctcaacgttgtcgtggtttcggatggaaattatgtgactgaagacctcagttgctaccgcgttagggtttgggttgacgaaatccgtatcgttgtcagaaacccaaccgccggctagacatgtatatggaccaccattatgctatagccatgtaggcgccttactatgaataaatgaaactatatataatgcatgcatagttggttggttggtcataatgtaacatctattgtttgcttgaatgattctggtgtccgatcatataacgcatttgaatg

SEQ ID NO: 147 - protein, 73 aa, Arabidopsis thaliana
  misc_feature (1)..(73): Ceres CDNA ID no. 4905097
  misc_feature (1)..(73): Sequence of endogenous gene to Ceres PROMOTER  YP0103
MATEWCSYIGKNSWPELLGTNGDYAASVIKGENSSLNVVVVSDGNYVTEDLSCYRVRVWVDEIRIVVRNPTAG

SEQ ID NO: 148 - DNA, 1000 bp, Arabidopsis thaliana
  misc_feature (1)..(1000): Predicted sequence of Ceres PROMOTER  YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatatattttagactatttggccttaactaaacttccactcattatttactgaggttagagaatagacttgcgaataaacacattcccgagaaatactcatgatcccataattagtcagagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 149 - DNA, 470 bp, Arabidopsis thaliana
  misc_feature (1)..(470): Experimental sequence of Ceres PROMOTER  YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactac

SEQ ID NO: 150 - DNA, 1521 bp, Arabidopsis thaliana
  misc_feature: Encoded by SEQ ID NO: 149
  misc_feature (1)..(1521): Ceres CDNA ID no. 12656458
  misc_feature (1)..(1521): Sequence of endogenous gene to Ceres PROMOTER  YP0107
atgacgtccgttaacgttaagctcctttaccgttacgtcttaaccaactttttcaacctctgtttgttcccgttaacggcgttcctcgccggaaaagcctctcggcttaccataaacgatctccacaacttcctttcctatctccaacacaaccttataacagtaactttactctttgctttcactgttttcggtttggttctctacatcgtaacccgacccaatccggtttatctcgttgactactcgtgttaccttccaccaccgcatctcaaagttagtgtctctaaagtcatggatattttctaccaaataagaaaagctgatacttcttcacggaacgtggcatgtgatgatccgtcctcgctcgatttcctgaggaagattcaagagcgttcaggtctaggtgatgagacgtacagtcctgagggactcattcacgtaccaccgcggaagacttttgcagcgtcacgtgaagagacagagaaggttatcatcggtgcgctcgaaaatctattcgagaacaccaaagttaaccctagagagattggtatacttgtggtgaactcaagcatgtttaatccaactccttcgctatccgctatggtcgttaatactttcaagctccgaagcaacatcaaaagctttaatctaggaggaatgggttgtagtgctggtgttattgccattgatttggctaaagacttgttgcatgttcataaaaacacttatgctcttgtggtgagcactgagaacatcacacaaggcatttatgctggagaaaatagatcaatgatggttagcaattgcttgtttcgtgttggtggggccgcgattttgctctctaacaagtcgggagaccggagacggtccaagtacaagctagttcacacggtccgaacgcatactggagctgatgacaagtcttttcgatgtgtgcaacaagaagacgatgagagcggcaaaatcggagtttgtctgtcaaaggacataaccaatgttgcggggacaacacttacgaaaaatatagcaacattgggtccgttgattcttcctttaagcgaaaagtttctttttttcgctaccttcgtcgccaagaaacttctaaaggataaaatcaagcattactatgttccggatttcaagcttgctgttgaccatttctgtattcatgccggaggcagagccgtgatcgatgagctagagaagaacttaggactatcgccgatcgatgtggaggcatctagatcaacgttacatagatttgggaatacttcatctagctcaatttggtatgaattagcatacatagaggcaaagggaagaatgaagaaagggaataaagcttggcagattgctttaggatcagggtttaagtgtaatagtgcggtttgggtggctctacgcaatgtcaaggcatcggcaaatagtccttggcaacattgcatcgatagatatccggttaaaattgattctgatttgtcaaagtcaaagactcatgtccaaaacggtcggtcctaa

SEQ ID NO: 151 - protein, 506 aa, Arabidopsis thaliana
  misc_feature (1)..(506): Ceres CDNA ID no. 12656458
  misc_feature (1)..(506): Sequence of endogenous gene to Ceres PROMOTER  YP0107
MTSVNVKLLYRYVLTNFFNLCLFPLTAFLAGKASRLTINDLHNFLSYLQHNLITVTLLFAFTVFGLVLYIVTRPNPVYLVDYSCYLPPPHLKVSVSKVMDIFYQIRKADTSSRNVACDDPSSLDFLRKIQERSGLGDETYSPEGLIHVPPRKTFAASREETEKVIIGALENLFENTKVNPREIGILVVNSSMFNPTPSLSAMVVNTFKLRSNIKSFNLGGMGCSAGVIAIDLAKDLLHVHKNTYALVVSTENITQGIYAGENRSMMVSNCLFRVGGAAILLSNKSGDRRRSKYKLVHTVRTHTGADDKSFRCVQQEDDESGKIGVCLSKDITNVAGTTLTKNIATLGPLILPLSEKFLFFATFVAKKLLKDKIKHYYVPDFKLAVDHFCIHAGGRAVIDELEKNLGLSPIDVEASRSTLHRFGNTSSSSIWYELAYIEAKGRMKKGNKAWQIALGSGFKCNSAVWVALRNVKASANSPWQHCIDRYPVKIDSDLSKSKTHVQNGRS

SEQ ID NO: 152 - DNA, 1000 bp, Arabidopsis thaliana
  misc_feature (1)..(1000): Predicted sequence of Ceres PROMOTER  YP0110
tcatctgctaggcgattaggtttcatacacacatgagtaaactgcactatctagttcatatacactccatcttattgatgatatttcaattttaaatagtaactcatatacttttcagtatttaatttattatttccttaaaccaaatttcaatcttacaatttcgaatttgcaatacaatttaaatatctattttatgataataaaaataaaatttaatttgattgtataaaattcaaatacaattcgattttgcaatagaaaacaatttaattctatacactccatctactattaattttccattatagttataaattagtatatgtaaatttgtttattttttttaggttttttctcttctaagagaaaaaaaaaaagttaaaatcttttccgatacatgtcaaaatataagatcgatagatttgccatgtgttacgatcgtatgagttattaactttgaaaatcatactttatataatacaaaacatgtaaatacatgtttatacatatatttacaactaaaaacatgtgtaaaatctaatggatttttaaatacatgcttttagctcgaaaaaaatttgatacggagaaaaaaatttgacgggaaataacatacgtaaatatctgatcaaattatctatagtacgattttgacgggaaaaaaaattattttaaaggaagagcttaactttgaatctcactaaaccagatcatacataatcaatcctttcttttatctttttttttcttttcattacgtgtaatcgtgttgtgtctaatatatcagtttgatttgtaataatttgaataaaaaagggagtgttgttatctttaagtttgcccaaaatctatagtcatgttcgatgtaaacgtatcttaaacaaaattattaaatgttaaagatagtaacatacaattattaatgaataaatgtttaactaattaaatatcatttagtgattgtcctataaaatctcttgttttcttgtttcatatc

SEQ ID NO: 153 - DNA, 629 bp, Arabidopsis thaliana
  misc_feature (1)..(629): Experimental sequence of Ceres PROMOTER  YP0110
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaacttt

SEQ ID NO: 154 - DNA, 653 bp, Arabidopsis thaliana
  misc_feature: Encoded by SEQ ID NO: 153
  misc_feature (1)..(653): Ceres CDNA ID no. 13604221
  misc_feature (1)..(653): Sequence of endogenous gene to Ceres PROMOTER  YP0110
atcaatcttacatccaaaacttaaagtattcttacatccaaaaacaaaaaaaatatggcaaagtctcttctcatagtaatgctcatgtctatagtaatgttttacatggctcgtccaattttctcccaaaaaattaatccatatttagaggtgatgccaaaagatgtgaccatatctccatcttcaaattttgattacgtcgaagctcccgatgaagctccattcgaagaagctgattcaccagcaatggaatatgacatggagcttgctcaccattattcggacaaacagctcaagtttcttgaggcttgctctgaaaagccgagttcaaaatgcggaaatgaggttttcaagaacatgttaaatgagacgatgctaattacagaggaatgttgtcgtgatatattgaagatgggcaaagattgccatctaggattggttaaactcatatttgccacatatgagtataaaaatattgcatctaagggcattccaaagagcaaacaaacatggaacgaatgtgtccatagagtggggagcaagattggtgctccggtctcttttgaacaatgaactaatatttccgtgtattgatgtgtctatgcgtttttgtaatttgattattactaatataaagcaactgctactatttt

SEQ ID NO: 155 - protein, 172 aa, Arabidopsis thaliana
  misc_feature (1)..(172): Ceres CDNA ID no. 13604221
  misc_feature (1)..(172): Sequence of endogenous gene to Ceres PROMOTER  YP0110
MAKSLLIVMLMSIVMFYMARPIFSQKINPYLEVMPKDVTISPSSNFDYVEAPDEAPFEEADSPAMEYDMELAHHYSDKQLKFLEACSEKPSSKCGNEVFKNMLNETMLITEECCRDILKMGKDCHLGLVKLIFATYEYKNIASKGIPKSKQTWNECVHRVGSKIGAPVSFEQ

SEQ ID NO: 156 - DNA, 1072 bp, Arabidopsis thaliana
  misc_feature (1)..(1072): Predicted sequence of Ceres PROMOTER  YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaacaaactaaagtcattgcactggttggtggtgatagagtgagagagaaaca

SEQ ID NO: 157 - DNA, 1129 bp, Arabidopsis thaliana
  misc_feature (1)..(1129): Experimental sequence of Ceres PROMOTER  YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaacaaactaaagttggtggtgatagagtgagagagaaacaccattgcactgggatccaacaatgtcctccgactcgtccaagatcaagaggaagcggaaccgcatcccg

SEQ ID NO: 158 - DNA, 1123 bp, Arabidopsis thaliana
  misc_feature: Encoded by SEQ ID NO: 157
  misc_feature (1)..(1123): Ceres CDNA ID no. 12703041
  misc_feature (1)..(1123): Sequence of endogenous gene to Ceres PROMOTER  YP0007
acagagacaacaaactaaagttggtggtgatagagtgagagagaaacatggaaggcaaagaagaagacgtcaatgttggagccaacaagttcccagagagacagccgatcggtacggcggctcagacggagagcaaggactataaggaaccaccaccggcgccgtttttcgaacccggcgagctcaaatcttggtctttctacagagcagggatagctgagttcatagccactttccttttcctctacgtcaccgttttgacagtcatgggtgttaagagagctcccaatatgtgtgcctctgttggaatccaaggcatcgcttgggcttttggtggcatgatctttgctcttgtttactgtactgctggaatctcaggaggacatattaatccggcggtgacttttggtttgttcttggcgaggaagctatctttaaccagagctctgttctacatagtaatgcagtgccttggagctatatgtggtgctggtgtggttaaagggtttcaaccagggctgtaccagacgaatggcggtggagctaatgtggtggctcatggttacacaaagggttcaggtcttggtgcagagattgttggaacttttgttctggtttacactgttttctcagctactgatgctaagagaagtgccagagactctcatgtccctatcttggctccgcttccaattgggtttgctgtcttcttggtgcacttggctaccatcccaattactggaactggcattaacccggccaggagtctcggagctgccatcatctacaacaaggatcatgcttgggatgaccattggatcttctgggtcggtccattcattggtgctgcgcttgctgctctgtaccatcagatagtcatcagagctattcctttcaagtccaagacataaagtttcctacatattctctgatcatcatcaagctaagaatatatcaatctttaattctatatgctttcttcttgtttcctatgtcatgtgtgatgatctctatatgtaccactagagctttgatcttgtaacagtgtaaatgtgtaatctattatgtatcaatggcattgtatcttgtaacattaattatgtcaatggaagaatacattgtg

SEQ ID NO: 159 - protein, 287 aa, Arabidopsis thaliana
  misc_feature (1)..(287): Ceres CDNA ID no. 12703041
  misc_feature (1)..(287): Sequence of endogenous gene to Ceres PROMOTER  YP0007
MEGKEEDVNVGANKFPERQPIGTAAQTESKDYKEPPPAPFFEPGELKSWSFYRAGIAEFIATFLFLYVTVLTVMGVKRAPNMCASVGIQGIAWAFGGMIFALVYCTAGISGGHINPAVTFGLFLARKLSLTRALFYIVMQCLGAICGAGVVKGFQPGLYQTNGGGANVVAHGYTKGSGLGAEIVGTFVLVYTVFSATDAKRSARDSHVPILAPLPIGFAVFLVHLATIPITGTGINPARSLGAAIIYNKDHAWDDHWIFWVGPFIGAALAALYHQIVIRAIPFKSKT

SEQ ID NO: 160 - DNA, 1000 bp, Arabidopsis thaliana
  misc_feature (1)..(1000): Predicted sequence of Ceres PROMOTER  YP0112
ttatgtgccctgatgtcctatgcagatggtgcaactactgcttttggtgagaagcttcgcgaacaagttgaggaaaggctagaattttatgacaaaggtgttgccccacgcaagaacgtggatgtaatgaaggaggtgatagagaatctaaagcaaggtatttcttgtagctgtttttttttggttgtaatcagagtcctctttatgatggcaaactcagtgtttttttatctgttcctcctttagaagaggaagggaaggagccagttgatgcctcggtgaagaaaagcaagaagaagaaggcaaagggtgaagaagaagaagaggtggtggcaatggaggaggacaagtcagagaaaaagaagaagaaagagaagaggaagatggagactgcagaggagaacgagaaatcagagaagaagaagacaaagaagagtaaagctggaggagaagaggagactgatgatggtcacagcaccaagaagaagaagaagaagtctaagagcgctgaatagaaagggatgcaacattaacaaaccctgtattgtattttttttttgagctaaattaatgtcgtctgtttttcgtagtgaacatcggagaatttttgttttggtctggaaacgattcaaggtttggcaatatcttaagtttgtttaggttttcactattttgacgtttgcaaccgtgaaggaggctcctccattttataaaatacaattaccaattccagtgctttgcaaatgtttcaataatagctaaactaactaccaaattggaaaactagcttaacaagtttgtgaaaatgaatttggagccatatgatttattattttacccaaatggagtaatagaagaagagcagctcgcgtttgaatggtcagttaacattaacaaaaggtaaaattgaatagatgttaaaacttgtgtaagtaaacaatagagctacctccttttgagaaggatagataaactcgtgaccaaccacattcccagtccc

SEQ ID NO: 161 - DNA, 840 bp, Arabidopsis thaliana
  misc_feature (1)..(840): Experimental sequence of Ceres PROMOTER  YP0112
ttatgtgccctgatgtcctatgcagatggtgcaactactgcttttggtgagaagcttcgcgaacaagttgaggaaaggctagaattttatgacaaaggtgttgccccacgcaagaacgtggatgtaatgaaggaggtgatagagaatctaaagcaaggtatttcttgtagctgtttttttttggttgtaatcagagtcctctttatgatggcaaactcagtgtttttttatctgttcctcctttagaagaggaagggaaggagccagttgatgcctcggtgaagaaaagcaagaagaagaaggcaaagggtgaagaagaagaagaggtggtggcaatggaggaggacaagtcagagaaaaagaagaagaaagagaagaggaagatggagactgcagaggagaacgagaaatcagagaagaagaagacaaagaagagtaaagctggaggagaagaggagactgatgatggtcacagcaccaagaagaagaagaagaagtctaagagcgctgaatagaaagggatgcaacattaacaaaccctgtattgtattttttttttgagctaaattaatgtcgtctgtttttcgtagtgaacatcggagaatttttgttttggtctggaaacgattcaaggtttggcaatatcttaagtttgtttaggttttcactattttgacgtttgcaaccgtgaaggaggctcctccattttataaaatacaattaccaattccagtgctttgcaaatgtttcaataatagctaaactaactaccaaattggaaaactagcttaacaagtttgtgaaaatgaatttggagccatatgatttattattttaccc

SEQ ID NO: 162 - DNA, 678 bp, Arabidopsis thaliana
  misc_feature: Encoded by SEQ ID NO: 161
  misc_feature (1)..(678): Ceres CDNA ID no. 12321680
  misc_feature (1)..(678): Sequence of endogenous gene to Ceres PROMOTER  YP0112
atattcttagtacaaataagaaattcacacccctcaaagaaatataacataatcaatcataggaaatatacttcgcataatgacgataatgatcaagtttctcctgttagctctgctcgtgatctctccgatttgcgccgagaaggacctgatgaaagaggaatgccataatgcacaagttccgaccatttgcatgcaatgtcttgaatccgacccaacctccgttcatgcagaccgtgttggcatcgccgagatcatcatacactgtctcgactctcgtctcgatatcatcaccaataacattacaaatatattgtcactgggaggaggaacgaaagaagtgagaaaaatcttggaggattgcagaaatgacacgtcgacggtggcacctaaactactgtcggaagccaaaacaggtctgaaaaccggtgattacgacaaagccgccaaatcgatagagtatgctagcattcctcatagctgtggattaaagcaaccaagtgtcgagtttgagtttcttcaactgtttagtcaaatcagtatctatactcaactctctgatgctgccatgagaatcattgatcgcttctaattactccacctttttatctctatgtaactcaacaacatcgatgcttaccatgcatcccccatataaataaatgattccctctttta

SEQ ID NO: 163 - protein, 170 aa, Arabidopsis thaliana
  misc_feature (1)..(170): Ceres CDNA ID no. 12321680
  misc_feature (1)..(170): Sequence of endogenous gene to Ceres PROMOTER  YP0112
MTIMIKFLLLALLVISPICAEKDLMKEECHNAQVPTICMQCLESDPTSVHADRVGIAEIIIHCLDSRLDIITNNITNILSLGGGTKEVRKILEDCRNDTSTVAPKLLSEAKTGLKTGDYDKAAKSIEYASIPHSCGLKQPSVEFEFLQLFSQISIYTQLSDAAMRIIDRF

SEQ ID NO: 164 - DNA, 935 bp, Arabidopsis thaliana
  misc_feature (1)..(935): Predicted sequence of Ceres PROMOTER  YP0116
aaacgcctcttcggtccacgctgtcgttttattgaaggaattatattttattttaattgggcctgcaggctaaactataagtccgtctgatatgggtcgggttgggcttatgagttatgggtctggtaggggtcaattagcttaatttcgatatgtgccctactctcgacctaacgttttgaacacgtaagagagagtttctaatattgagttgtctaattaactcgataggcttatacaaagtgtttccgcattttaccttcttaataactcatcattcactaactaagaaaagttttactcagaccatatcttccgcttcttgattattgtcaatttgttgtcactcaatttatctcttgcaaaatttagttgaaatcatttggtttcatctttggctcttgaatagttgcatgtgtgtatttagtaagttcttttcaattaagaaggaagaataaaacaaattgtggccagaaacaattatgttgagttttatctcatacgttggctcattcatccccatctctctgcttttgaatcattctactcctcccattttttgatcgtcctttttcctgcttctgaacatggatcattgtgcatgttcggatgttcctcgatcgtgctgaaactcaaagtctgaatcgattaccatagactctcaacccatctttgatatataaaaaagagccttaacccatctcttctactctccctctctagaaacaaacacatcacgtgatgatctgtttccccccatacttacgggatgatcagaatgtggcatgaggaaaaagccaagaaataagttgataaatttaaggtttaatttaacaaaaatgagagattaatcttttcattttagggtcgcacgcggtgttttgtgcaaccgcagaaacttcctataaataccgatacaatgtgcatgctttcta

SEQ ID NO: 165 - DNA, 1085 bp, Arabidopsis thaliana
  misc_feature (1)..(1085): Experimental sequence of Ceres PROMOTER  YP0116
  misc_feature (1065)..(1065): n is a, c, t, g, unknown, or other
  misc_feature (1082)..(1082): n is a, c, t, g, unknown, or other
aaacgcctcttcggtccacgctgtcgttttattgaaggaattatattttattttaattgggcctgcaggctaaactataagtccgtctgatatgggtcgggttgggcttatgagttatgggtctggtaggggtcaattagcttaatttcgatatgtgccctactctcgacctaacgttttgaacacgtaagagagagtttctaatattgagttgtctaattaactcgataggcttatacaaagtgtttccgcattttaccttcttaataactcatcattcactaactaagaaaagttttactcagaccatatcttccgcttcttgattattgtcaatttgttgtcactcaatttatctcttgcaaaatttagttgaaatcatttggtttcatctttggctcttgaatagttgcatgtgtgtatttagtaagttcttttcaattaagaaggaagaataaaacaaattgtggccagaaacaattatgttgagttttatctcatacgttggctcactcatccccatctctctgcttttgaatcattctactcctcccattttttgatcgtccttttttctgcttctgaacatggatcattgtgcatgttcggatgttcctcgatcgtgctgaaactcaaagtctgaatcgattaccatagactctcaacccatctttgatatataaaaaagagccttaacccatctcttctactctccctctctagaaacaaacacatcacgtgatgatctgtttccccccatacttacgggatgatcagaatgtggcatgaggaaaaagccaagaaataagttgataaatttaaggtttaatttaacaaaaatgagagattaatcttttcattttagggtcgcacgcggtgttttgtgcaaccgcagaaacttcctataaataccgatacaatgtgcatgctttctacaactcaactcactcaaaccaaaaaaagaaacatcaaaccccaaaacacacataacaatcacaaaccattgcactgggatccaacaatgtcctccgactcgtccaagatcaagaggaagcggaaccgcancccgtttggaaatcagnccg

SEQ ID NO: 166 - DNA, 1003 bp, Arabidopsis thaliana
  misc_feature: Encoded by SEQ ID NO: 165
  misc_feature (1)..(1003): Ceres CDNA ID no. 12325134
  misc_feature (1)..(1003): Sequence of endogenous gene to Ceres PROMOTER  YP0116
aactcaactcactcaaaccaaaaaaagaaacatcaaaccctaaaacacacataacaatcacaaatgaagaatccttcagtgatctcttttctcatcattctcctgtttgctgcaactatttgcacccacggaaatgaaccggtgaaggatacagccggaaatccacttaacacccgcgaacaatacttcatccagccggttaagaccgagagtaaaaacggaggtggtcttgtcccagccgccattacagtacttcccttttgtccacttggcatcacccaaacacttcttccctaccaacccggcctaccggttagcttcgtattagcacttggcgtaggatcaaccgttatgacatcttcggctgtaaacatcgagttcaagtccaacatctggccgttttgcaaggagttttccaagttttgggaagttgatgattcctcatcagctcccaaggagccttcaattctcatcggtggtaaaatgggggaccgaaatagctcgtttaagattgagaaagctggagaaggagctagagcaaacgtttataagttgaccaccttttacggaaccgttggagccatcccaggggtttggttaagcgcaccacaactaattatcaccaaggatacggctaagaccttactcgtcaaattcaaaaaggttgatgatgctactacggctactagcaacttatacttcccgggttgataatttaggtctaaggatgttcccgttctactaatcaactggtaaaaattattgtaatattaagcctgagactcgtccatggcctaaaataatgagttattttcaaatttcaattaataagaaagaaaaatgtggccagatccagatacatagatgttgagaatcattcataggcattgctgttgaatctgtttaaggcatgaaatagttttcttcttcattctactttgtatccgaaaattttctctcctcttgtaaagatcttgagcttgagaaaacattgatcattcat

SEQ ID NO: 167 - protein, 215 aa, Arabidopsis thaliana
  misc_feature (1)..(215): Ceres CDNA ID no. 12325134
  misc_feature (1)..(215): Sequence of endogenous gene to Ceres PROMOTER  YP0116
MKNPSVISFLIILLFAATICTHGNEPVKDTAGNPLNTREQYFIQPVKTESKNGGGLVPAAITVLPFCPLGITQTLLPYQPGLPVSFVLALGVGSTVMTSSAVNIEFKSNIWPFCKEFSKFWEVDDSSSAPKEPSILIGGKMGDRNSSFKIEKAGEGARANVYKLTTFYGTVGAIPGVWLSAPQLIITKDTAKTLLVKFKKVDDATTATSNLYFPG

SEQ ID NO: 168 - DNA, 1000 bp, Arabidopsis thaliana
  misc_feature (1)..(1000): Predicted sequence of Ceres PROMOTER  YP0117
aatcacagtcctttatgataaaacgaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaatgaatttaatatattctaagtaacttgcttaaattttttttcaaactctaaagacataactaacataaagtaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagc

SEQ ID NO: 169 - DNA, 1100 bp, Arabidopsis thaliana
  misc_feature (1)..(1100): Experimental sequence of Ceres PROMOTER  YP0117
gtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcaccattgcactgggatccaacaatgtcctccgactcgtccaagatcaagaggaagcggaaccgcatcccgttaaacgaaggcg

SEQ ID NO: 170 - DNA, 828 bp, Arabidopsis thaliana
  misc_feature: Encoded by SEQ ID NO: 169
  misc_feature (1)..(828): Ceres CDNA ID no. 13617054
  misc_feature (1)..(828): Sequence of endogenous gene to Ceres PROMOTER  YP0117
actcaacacaaactctttacgaatacttttaagtatggcttcttcttctgcaaccaagtttgttgatctgttcccatgtcttttcttagcttgcctcttcgtgttcacatactcaaacaacctcgtcgtggctgaaaattccaacaaagtgaagatcaatctttactatgaatcactttgtccctattgtcaaaatttcattgttgatgatctaggtaaaatctttgactccgatctcctcaaaatcaccgatctcaagctcgttccattcggtaacgctcatatctccaataatctgactattacttgccagcatggtgaagaggaatgcaaacttaacgctctcgaagcttgcggtataagaactttgcccgatccgaaattgcagtacaagttcatacgctgcgttgaaaaagatacgaatgaatgggaatcatgtgttaaaaaatctggacgtgagaaagccatcaatgattgttacaatggtgatctctctcaaaagctgatacttgggtatgcaaaactgacctcgagtttgaagccaaaacatgaatacgtaccatgggtcacactcaacggcaaaccactctatgacaattaccataatttggtcgcacaagtctgcaaagcgtacaaaggaaaggatctcccaaaactatgcagttcctcggtcttgtatgagaggaaagtgtcaaagtttcaagtctcctatgtagatgaagctatcaattaataagttaattaacaaacttcttattgaaactaagatggatctaatctttatgctataagtggaatgataaataaagacgttttatctgaactttt

SEQ ID NO: 171 - protein, 232 aa, Arabidopsis thaliana
  misc_feature (1)..(232): Ceres CDNA ID no. 13617054
  misc_feature (1)..(232): Sequence of endogenous gene to Ceres PROMOTER  YP0117
MASSSATKFVDLFPCLFLACLFVFTYSNNLVVAENSNKVKINLYYESLCPYCQNFIVDDLGKIFDSDLLKITDLKLVPFGNAHISNNLTITCQHGEEECKLNALEACGIRTLPDPKLQYKFIRCVEKDTNEWESCVKKSGREKAINDCYNGDLSQKLILGYAKLTSSLKPKHEYVPWVTLNGKPLYDNYHNLVAQVCKAYKGKDLPKLCSSSVLYERKVSKFQVSYVDEAIN

SEQ ID NO: 172 - DNA, 1000 bp, Arabidopsis thaliana
  misc_feature (1)..(1000): Predicted sequence of Ceres PROMOTER  YP0118
aattgagaaaggtgcctcaatttcagtagaacctgacgcaaaatttcgcgatcatgcatgactcaaattggtttattcacttaaataaaaaagttgtttccctatctagttgaagttctcaattcaaacgcaacttcttactttttctttttatttatactggaatgaatttttcgtcaatgctagacctcaatatttggtgattaagtccaaaaaattatagcaatattcattagttaaatcataataatatttgttatttctgctaaatatattagttttaaattggtaaatatatcagtcatcatactttatatatgtgcacaagaaaaagaggaaaaaaaactaacttttaataaattgaacgctatcctctatatctcgtcctggtccaaatgtaaacttcaatatccttttgattttattgctgattgctttaaaaaatttcacaaacacttttatcattcttttattccaccaaaatctacagacataatactttgtaattttatgtaaaaatcttcaaaatttgggaaaagaaaaatcatttaaaatcaatttgcattaactggatttatttccaaaggtgtggtattgtgtttatatatgtggagttgttggctagtaatataataaggaaaagagtgaaacatatgtagtataacgtatttctagtttttttctctgtattaatgaatcactaattaagtagtatgcattaattgaattatcagaagctggtcacaaaagtctaccaaaaaaaacaaaaaaattggtcagaagaaaatgaaaataatgagaataaaaaagggaaaaaaaataagaagctagcaaacaaagcaattaacatttcaaggcagttaattcatcatgcaaggtgcttatgtgtgacaacgtcatgcgttactttttgcgtctacactcatctctctaacgcaatccactaattctggtaatggattctgctatttagaccagccagtttcttcgtctctcaatc

SEQ ID NO: 173 - DNA, 413 bp, Arabidopsis thaliana
  misc_feature (1)..(413): Experimental sequence of Ceres PROMOTER  YP0118
aattgagaaaggtgcctcaatttcagtagaacctgacgcaaaatttcgcgatcatgcatgactcaaattggtttattcacttaaataaaaaagttgtttccctatctagttgaagttctcaattcaaacgcaacttcttactttttctttttatttatactggaatgaatttttcgtcaatgctagacctcaatatttggtgattaagtccaaaaaattatagcaatattcattagttaaatcataataatatttgttatttctgctaaatatattagttttaaattggtaaatatatcagtcatcatactttatatatgtgcacaagaaaaagaggaaaaaaaactaacttttaataaattgaacgctatcctctatatctcgtcctggtccaaatgtaaacttcaatatcc

SEQ ID NO: 174 - DNA, 1563 bp, Arabidopsis thaliana
  misc_feature: Encoded by SEQ ID NO: 173
  misc_feature (1)..(1563): Ceres CDNA ID no. 12329827
  misc_feature (1)..(1563): Sequence of endogenous gene to Ceres PROMOTER  YP0118
aatcatcatccaaaaacattcttctcacaagaatcagattcaagatagaagtttttcaaacaatgtctagtcctcttggtcactttcagattcttgtttttcttcatgctttgcttatcttctcagctgagtcccgcaaaacccaattgctgaacgataatgatgttgaatctagcgacaagagtgcaaaaggcacacgatgggctgttttagttgctggatcaaatgaatattataactacaggcatcaggctgacatatgccacgcgtatcagatactccgaaaaggcggtttaaaagatgaaaacatcattgtgtttatgtatgatgatatcgcgttttcctcggagaatcctaggcctggagttatcattaataaaccagatggagaagatgtttataaaggagttcctaaggactacactaaagaagctgttaatgttcaaaacttctacaatgtgttacttggaaatgaaagtggcgtcacaggaggaaatggcaaagttgtgaaaagtggtcctaatgataatatcttcatctattatgctgaccatggagctcctggcttaatagcgatgcccactggtgatgaagttatggcaaaagatttcaatgaagtcttggagaagatgcataagagaaaaaaatacaacaagatggtgatctatgttgaagcatgtgaatcaggaagtatgtttgaagggattttaaagaaaaatctcaacatatacgcagtgactgctgctaattctaaagagagcagctggggagtttactgtcctgagtcatatcctcctcctccttctgagattggaacttgtctcggcgatacatttagcatctcttggcttgaggacagtgaccttcatgacatgagcaaagagactttggagcaacaataccacgttgtaaagagaagagtaggatctgatgtaccagagacttctcatgtatgccgtttcggaacagagaagatgcttaaagattatctttcctcttacattggaagaaatcctgaaaacgataacttcactttcacggaatccttttcctcaccaatctctaattctggcttggtcaatccgcgcgatattcctctgctatacctccagagaaagattcaaaaagctccaatgggatcacttgaaagcaaagaagctcagaagaaattgcttgacgaaaagaatcataggaaacaaatcgatcagagcattacagacattctgcggctttcagttaaacaaaccaatgtcttaaatctcttaacttccacaagaacaacaggacagcctcttgtagacgattgggattgcttcaagactctagttaatagcttcaagaatcactgcggtgcaacggtgcattacggattgaagtatacaggagcgcttgccaatatctgcaatatgggagtggatgtgaagcaaactgtttcagccattgaacaagcttgttcgatgtaatgatttgcaaaacaatgtgatattcgactttaaaaatatcaaagttaatttcaataaaactcgatgtagagatggttggttcatgatactacttttacat

SEQ ID NO: 175 - protein, 466 aa, Arabidopsis thaliana
  misc_feature (1)..(466): Ceres CDNA ID no. 12329827
  misc_feature (1)..(466): Sequence of endogenous gene to Ceres PROMOTER  YP0118
MSSPLGHFQILVFLHALLIFSAESRKTQLLNDNDVESSDKSAKGTRWAVLVAGSNEYYNYRHQADICHAYQILRKGGLKDENIIVFMYDDIAFSSENPRPGVIINKPDGEDVYKGVPKDYTKEAVNVQNFYNVLLGNESGVTGGNGKVVKSGPNDNIFIYYADHGAPGLIAMPTGDEVMAKDFNEVLEKMHKRKKYNKMVIYVEACESGSMFEGILKKNLNIYAVTAANSKESSWGVYCPESYPPPPSEIGTCLGDTFSISWLEDSDLHDMSKETLEQQYHVVKRRVGSDVPETSHVCRFGTEKMLKDYLSSYIGRNPENDNFTFTESFSSPISNSGLVNPRDIPLLYLQRKIQKAPMGSLESKEAQKKLLDEKNHRKQIDQSITDILRLSVKQTNVLNLLTSTRTTGQPLVDDWDCFKTLVNSFKNHCGATVHYGLKYTGALANICNMGVDVKQTVSAIEQACSM

SEQ ID NO: 176 - DNA, 1000 bp, Arabidopsis thaliana
  misc_feature (1)..(1000): Predicted sequence of Ceres PROMOTER  YP0126
cattgtatctgagatgtgactgtgaagaacaaagattcatgacatggtattgttaagccgcccattggatgatcataaccaaactcttcctcagatttactcaacagttgttgaaacaaaggctggtttaagtatgaaaccggcaccacatatctcttcttcttctgatcattctctcctacatagaccgccatgaatcctcttggtgtcgacgatgattcccttcgaataatttgcttagcacccaagaaactcctcaaaaaagccatattttcccttatgttttcctgaagcttaaatgtttcttagtcttggagaaagctttgagattttaaaattggatcttctttagtttgtgaatctaaaggggtttagttacttgttatataaacgaacgtatgaaagaaatgattaagtatttttgaggtttttctttttaattacagagcacatggctttgggttgtagatactaaaccaagaacaaatcaataaatggtgtctgagaagttagtgtctaatgatgtcctacatgataacttcattggggcttatttgtctcaaagacatcacatgccaaatctctctatagattatgtagggacatgaagttgtgtacctaatgaaccacaagtctctatcactgattaagtcataccttcttctcaatgatattcaaaagacaggaccacatgatttgattatatactgacaaagtcacaaaagccttcaaaaaaattctgtggcaagaaaggaaaatttgactagttatagtgtctatctaacaaacaagtggtcatattgatttctgtcttcacatcagaaatcatgaagattgatcactatagggcccttacttatcatgccgtggtccggcaaagccatgtgcttgcttgttggtgtaaaaatttatgagctgaaacttttgaaaccaataaagggttatctacaagtaatgttcttatctatatatactcatcactgactcctttctgctctgc

SEQ ID NO: 177 - DNA, 455 bp, Arabidopsis thaliana
  misc_feature (1)..(455): Experimental sequence of Ceres PROMOTER  YP0126
cattgtatctgagatgtgactgtgaagaacaaagattcatgacatggtattgttaagccgcccatgtggatgatcataaccaaactctgtcctcagatttactcaacagtgtgtgtgaaacaaaggctggtttaagtatgaaaccggcaccacatatctcttcttcttctgatcattctctcctacatagaccgccatgaatcctcttggtgtcgacgatgattcccttcgaataatttgcttagcacccaagaaactcctcaaaaaagccatattttcccttatgttttcctgaagcttaaatgtttcttagtcttggagaaagctttgagattttaaaattggatcttctttagtttgtgaatctaaaggggtttagttacttggtatataaacgaacgtatgaaagaaatgattaaggatttttgaggtttttctttttaattacagagcac

SEQ ID NO: 178 - DNA, 547 bp, Arabidopsis thaliana
  misc_feature: Encoded by SEQ ID NO: 177
  misc_feature (1)..(547): Ceres CDNA ID no. 12713856
  misc_feature (1)..(547): Sequence of endogenous gene to Ceres PROMOTER  YP0126
aagtttctcacattttccaataaagcatctaacttacaattaaagacaatccatggcgatcagaatccctcgtgtgctgcaatcatcgaagcagattctccgacaagccaaactgttgtcatcatcttcttcttctagctctcttgatgttcccaaaggctacttagcggtttacgtaggagaacaaaatatgaagagatttgtagttccggtttcgtacttggaccagccttcatttcaagatctattaagaaaggcagaggaagagtttggatttgatcatccaatgggtggcctcacaatcccttgcagtgaagaaatttttattgatcttgcttctcgcttcaactgatcatgactcactcgataaccttacttttgtcattgatttttgtacattttgttttcccaattagttttcttcaagagatgagatgacttagaaacagcatctctccttgaaagtgaaacagagacttgtaacactctttttcctcacttacagtgagttggactcaaatctaatcaaaaccatcatttagtcatc

SEQ ID NO: 179 - protein, 99 aa, Arabidopsis thaliana
  misc_feature (1)..(99): Ceres CDNA ID no. 12713856
  misc_feature (1)..(99): Sequence of endogenous gene to Ceres PROMOTER  YP0126
MAIRIPRVLQSSKQILRQAKLLSSSSSSSSLDVPKGYLAVYVGEQNMKRFVVPVSYLDQPSFQDLLRKAEEEFGFDHPMGGLTIPCSEEIFIDLASRFN

SEQ ID NO: 180 - DNA, 1041 bp, Arabidopsis thaliana
  misc_feature (1)..(1041): Predicted sequence of Ceres PROMOTER  YP0127
acgtttaaagttgagacataaaacagtgatttcaaatttgtattagggtggtcttattgtgtgtctagctactagctagagaatactagaagaagaatacgtagcaagatacgcacaacatttggtcctctcttttttttactttcttttaacacattgtcctcttatgatttgcttattgatttcagtatctttttgtatcaataattccctccaaatgattaaaccctaaaaaaatgtgattcattcaccacccgaagattagcatcatcaagtaacacacaataactaccaataacctagttttcatttttctatactaaaatcctaaacatcccataaaaatacaaacaactctgaaccaataatttcctctaatccacgtgcaccccatcgtctcctgacgtaagatttgtctataacttatcaaatcccaaattcagctttgttttcattatatagtacgtactcttataaaaaagagaagagtacacatctttaatactttaacttaaaagaagaaagtaatactaatataagaggagtctgagtcagcgacaagtgttcgcggagaaacggaaacgctctctttctctctcttcccccaacgccaatacctttggaatccctccctaactctgtcctgtcctttcgtcctcactttctctctttttacattttctacacaccaataaaattgaaaccagcaacttataaatcaactcaagtttgaattaatgatcgaaaaactagtttatttgtgtcaatatgacccattctttattcacataagtattttaacttttcaaaatgttatctcaatctcctttgagtttctgtcttccccataataaatttcaaataattaatacacatggttttttaattagaaataatggaaaagaaaggacaaaggaataaaaaagaaacacaagttggcacactctctttattattcactcccctctataaatctcatactatcttctctcatcttcttaaatattggatatatttctttttcaaatttcggaaaagaaa

SEQ ID NO: 181 - DNA, 445 bp, Arabidopsis thaliana
  misc_feature (1)..(445): Experimental sequence of Ceres PROMOTER  YP0127
tcagtgagtcgattggaacgtttaaagttgagacataacgcagtgatttcaaatttgtattagggtggtcttattgtgtgtctagctactagctagagaatactagaagaagaatacgtagcaagatacgcataacatttggtcctctcttttttttactttcttttaacacattgtcctcttatgatttgcttattgatttcagtatctttttgtatcaataattccctccaaatgattaaaccctaaaaaaatgtgattcattcaccacccgaagattagcatcatcaagtaacacacaataactaccaataacctagttttcatttttctatactaaaatcctaaacatcccataaaaatacaaacaactctgaaccaataatttcctctaatccacgtgcaccccatcgtctcctgacgtaagatttgtctataacttatc

SEQ ID NO: 182 - DNA, 987 bp, Arabidopsis thaliana
  misc_feature: Encoded by SEQ ID NO: 181
  misc_feature (1)..(987): Ceres CDNA ID no. 13617784
  misc_feature (1)..(987): Sequence of endogenous gene to Ceres PROMOTER  YP0127
gaaacttgttttctctttcccttcttcaatcaaaacctatttgcatgctctcaaacccgaattaaatcgacacttttcagtttttgttttaacaagtagagtttcccaaaatattggatatatttctttttcaaatttcggaaaagaaatgagttgcaatggatgtagagttcttcgaaaaggttgcagtgaaacatgcatccttcgtccttgccttcaatggatcgaatccgccgagtcacaaggccacgccaccgtcttcgtcgctaaattctttggtcgtgctggtctcatgtctttcatctcctccgtacctgaactccaacgtcctgctttgtttcagtcgttgttgtttgaagcgtgtgggagaacggtgaatccggttaacggagcggttggtatgttgtggaccaggaactggcacgtatgccaagcggcggttgagactgttcttcgcggcggaactttacgaccgatatcagatcttcttgaatctccgtcgttgatgatctcctgtgatgagtcttcagagatttggcatcaagacgtttcaagaaaccaaacccaccattgtcgcttctccacctccagatccacgacggagatgaaagactctctggttaaccgaaaacgattgaagtccgattcggatcttgatctccaagtgaaccacggtttaaccctaaccgctccggctgtaccggttccttttcttcctccgtcgtcgttttgtaaggtggttaagggtgatcgtccgggaagtccatcggaggaatctgtaacgacgtcgtgttgggaaaatgggatgagaggagataataaacaaaaaagaaacaaaggagagaaaaagttattgaacctttttgtttaaaaccgacgacgcaaaacactcaaagattttgaggctctcttttttagggttttgagtgggaatggatatttagttaatgatttttctctatcgagaaatatgataaaattttgggg

SEQ ID NO: 183 - protein, 240 aa, Arabidopsis thaliana
  misc_feature (1)..(240): Ceres CDNA ID no. 13617784
  misc_feature (1)..(240): Sequence of endogenous gene to Ceres PROMOTER  YP0127
MSCNGCRVLRKGCSETCILRPCLQWIESAESQGHATVFVAKFFGRAGLMSFISSVPELQRPALFQSLLFEACGRTVNPVNGAVGMLWTRNWHVCQAAVETVLRGGTLRPISDLLESPSLMISCDESSEIWHQDVSRNQTHHCRFSTSRSTTEMKDSLVNRKRLKSDSDLDLQVNHGLTLTAPAVPVPFLPPSSFCKVVKGDRPGSPSEESVTTSCWENGMRGDNKQKRNKGEKKLLNLFV

SEQ ID NO: 184 - DNA, 973 bp, Arabidopsis thaliana
  misc_feature (1)..(973): Predicted sequence of Ceres PROMOTER  YP0128
gataaactgataatggaaaagaacaaagaaaccagtttttaactatttgcatatgtaatttatttgttgcaaattatatttagttaaaatgtttcctctatttatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcgtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaa

SEQ ID NO: 185 - DNA, 426 bp, Arabidopsis thaliana
  misc_feature (1)..(426): Experimental sequence of Ceres PROMOTER  YP0128
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctc

SEQ ID NO: 186 - DNA, 1607 bp, Arabidopsis thaliana
  misc_feature: Encoded by SEQ ID NO: 185
  misc_feature (1)..(1607): Ceres CDNA ID no. 13610584
  misc_feature (1)..(1607): Sequence of endogenous gene to Ceres PROMOTER  YP0128
ataatccaaacaccaaaaacaaaatggagaaattgctcgtgatctctttgctactactgatctcaacatcagttacaacttcacaatccgtgaccgatccaatagctttcctccgatgtctcgatagacaaccaacggacccaacaagtcctaactccgccgttgcttacatcccaacaaactcttctttcaccactgtcctccgcagccgtatacctaacctccgtttcgacaaacccactactccaaaacccatctccgtggtggctgccgccacgtggacacacatacaagctgctgtaggatgcgcacgtgagctctctctccaagtcaggatcagaagtggtggccacgacttcgaaggactctcttacacttccaccgtccctttctttgttctcgacatgttcggttttaaaaccgtggacgtaaatctcaccgagagaacggcttgggttgattctggtgctaccctcggagagctttactatagaatctctgagaagagcaatgttcttggatttccggcgggtttgtctaccacattgggcgttggtggacactttagcggcggaggatacggtaatctgatgagaaagtatggtttgtcggtggataacgttttcggctccgggatcgttgattcgaacggaaatatcttcaccgatcgggtttcgatgggggaagaccgtttttgggcgattcgtggaggtggtgcagcgagctacggtgttgtcctcggctacaagatccagctagtaccggtgcctgagaaagttacggtttttaaagtcggaaaaactgtcggagaaggagccgttgatcttataatgaagtggcagagttttgctcatagtacggatcggaatttgttcgtgaggttaactttgactttagtcaacggtacgaagcctggtgagaatacggttttagcgactttcattgggatgtatttaggccggtcggataagctgttgaccgtgatgaaccgggatttcccggagttgaagctgaagaaaaccgattgtaccgagatgagatggatcgattcggttctgttttgggacgattatccggttggtacaccgacttctgtgctactaaatccgctagtcgcaaaaaagttgttcatgaaacgaaaatcggactacgtgaagcgtctgatttcgagaaccgatctcggtttgatactcaagaaattggtagaggttgagaaagttaaaatgaattggaatccgtatggaggaaggatgggtgagatcccgagttcgaggacaccattcccacatagagcaggcaatttgttcaacattgagtatatcatagactggtcagaagctggagataatgtggagaagaaatatttggcactcgcgaatgaattttatagattcatgaccccgtacgtgtctagtaatccgagggaggcgtttttgaattaccgtgatcttgacatagggtcaagtgttaagtctacgtaccaggaaggtaaaatctacggggctaaatatttcaaggagaatttcgagagattagtggatattaaaaccacgattgatgcggaaaacttttggaaaaacgaacaaagcattccggttagaagataa

SEQ ID NO: 187 - protein, 527 aa, Arabidopsis thaliana
  misc_feature (1)..(527): Ceres CDNA ID no. 13610584
  misc_feature (1)..(527): Sequence of endogenous gene to Ceres PROMOTER  YP0128
MEKLLVISLLLLISTSVTTSQSVTDPIAFLRCLDRQPTDPTSPNSAVAYIPTNSSFTTVLRSRIPNLRFDKPTTPKPISVVAAATWTHIQAAVGCARELSLQVRIRSGGHDFEGLSYTSTVPFFVLDMFGFKTVDVNLTERTAWVDSGATLGELYYRISEKSNVLGFPAGLSTTLGVGGHFSGGGYGNLMRKYGLSVDNVFGSGIVDSNGNIFTDRVSMGEDRFWAIRGGGAASYGVVLGYKIQLVPVPEKVTVFKVGKTVGEGAVDLIMKWQSFAHSTDRNLFVRLTLTLVNGTKPGENTVLATFIGMYLGRSDKLLTVMNRDFPELKLKKTDCTEMRWIDSVLFWDDYPVGTPTSVLLNPLVAKKLFMKRKSDYVKRLISRTDLGLILKKLVEVEKVKMNWNPYGGRMGEIPSSRTPFPHRAGNLFNIEYIIDWSEAGDNVEKKYLALANEFYRFMTPYVSSNPREAFLNYRDLDIGSSVKSTYQEGKIYGAKYFKENFERLVDIKTTIDAENFWKNEQSIPVRR

SEQ ID NO: 188 - DNA, 999 bp, Arabidopsis thaliana
  misc_feature (1)..(999): Predicted sequence of Ceres PROMOTER  YP0020
cagagcagtgcatatttttttttttttttttttggtgttagtgcatatctatatatatagtactattataatatatttcaatatatatattttaagaaaatatctgattcttaagtttggacttatttgtcaacaatagccagtaaaaaacaaaagcgaagtttcactaacttaaaaaataaccacatttgtatatttcgaatacatactataaattaataaatttatcaaaacaactatagaaactgttatttccaatcaatttctttatcaagattatatctgaaatatatttattaaaattaatagttatttacaagaactatttttatgaaagtgtaagaactctctgaaaacttgataagtcaatattttttctaacatcgtaaacataaactagattcaaattcgaatctagttattcaaaaacttataaaaacataaaaatgaaatactgttacttcaacaaaaaaacattattattattttgtttaaatatctaaatttattcatcaacagcaaaatatttaaaagagtgggaaacaaataaaaattaaactctgttttggtatgataaaattatttactaaactaaactcaattttttttagtatcacggttataactataacaataatcgaactttgttattttcttggtactggttttagtagtatagatagatattttagtcataactcataagatacatgtacaaatatttgctatatatgatcagtgataactgaatttcgtgctgaaaattgccatagtttgcttattttactcttgaaacaataacgatatggtcgttacttaaaacaacattttaaaaacgaagaaaattaaacagagtttgttaaaataaattaaataccataaatttctctttgactcttcctatatagtaaaatctctcatccccttctctctctctctcatagcatgttggtctttaggttcctatataaacaacgccacacacacccatttagtccc

SEQ ID NO: 189 - DNA, 503 bp, Arabidopsis thaliana
  misc_feature (1)..(503): Experimental sequence of Ceres PROMOTER  YP0020
cagagcagtgcatatttttttttttttttttttggtgttagtgcatatctatatatatagtactattataatatatttcaatatatatattttaagaaaatatctgattcttaagtttggacttatttgtcaacaatagccagtaaaaaacaaaagcgaagtttcactaacttaaaaaataaccacatttgtatatttcgaatacatactataaattaataaatttatcaaaacaactatagaaactgttatttccaatcaatttctttatcaagattatatctgaaatatatttattaaaattaatagttatttacaagaactatttttatgaaagtgtaagaactctctgaaaacttgataagtcaatattttttctaacatcgtaaacataaactagattcaaattcgaatctagttattcaaaaacttataaaaacataaaaatgaaatactgttacttcaacaaaaaaacattattattattttgtttaaatatctaa

SEQ ID NO: 190 - DNA, 1721 bp, Arabidopsis thaliana
  misc_feature: Encoded by SEQ ID NO: 61
  misc_feature (1)..(1721): Ceres CDNA ID no. 12576899
  misc_feature (1)..(1721): Sequence of endogenous gene to Ceres PROMOTER  YP0020
aaccaaagactctttaccatctctttctctctctgtttgaagacatagcacaaaaaaaaaaaaaaagacagagcaaaaaaacacacaaagatgggcataatgatgatgattttgggtcttcttgtgatcattgtttgtttatgtactgctcttctccgatggaaccagatgcgatattctaagaaaggtcttcctcctggaaccatgggctggccaatatttggtgaaacgactgagtttcttaaacaaggaccagatttcatgaaaaaccaaagactaagatatgggagtttcttcaagtctcacattcttggttgcccaacaatagtctcaatggacgcagagttaaacagatacattctaatgaatgaatcgaaaggacttgttgccggttacccgcaatctatgcttgatattctagggacatgcaacatagctgcggttcatggcccgagccaccggctaatgagaggctcgttgctttctttaataagcccaaccatgatgaaagaccatctcttgcctaagattgatgatttcatgagaaactatctttgtggttgggatgatcttgagacagttgatatccaagaaaagaccaaacatatggcatttttatcatcgttgttacaaatagctgagactttgaaaaaaccagaggttgaagaatatagaacagagtttttcaagcttgttgtgggaactctatcggtcccgatcgatatcccgggaacgaattaccgcagtggagtccaagcaagaaacaacatcgataggttattgacagaactgatgcaagaaagaaaagagtctggagaaactttcacagacatgttgggttacttgatgaagaaggaagataaccgatacttgttaaccgataaagagataagagatcaagtggtaacgatcttgtattccggttatgagactgtctctacaacctccatgatggctcttaagtatctccatgatcatccaaaagctcttgaagaactcagaagagaacatttggctataagggagagaaaacgacctgacgaaccgctcactctcgacgatattaaatcgatgaaattcactcgagctgtgatctttgagacatcaagattggcaacgattgttaatggtgtccttaggaaaactactcacgacttagaactcaacggttatttaatcccaaaaggttggagaatttacgtatacacaagagagattaactatgatacatctctttatgaagatccaatgatctttaacccatggagatggatggaaaagagcttagaatcaaagagctatttcttactctttggaggtggagttaggctttgccctggaaaggaactaggaatctcggaagtctcaagcttccttcactactttgttacaaaatatagatgggaagagaatggagaagacaaattaatggtctttccaagagtttctgcaccaaaaggataccatcttaagtgttcaccttactgactagttttgtcctaatattgaaaaatgtgtaaataaatctattaagggtcattttgtagggctaattaacctattttatctattaaatctctcaagatcatagaggagatggataatgtacagagagaaagagagaagaagaaaatggaatatagaaaaaaataaaatatttgaaatgttgagcttagtctcttatcttgtaaatttgtaacccataaatttttacatttcat

SEQ ID NO: 191 - protein, 465 aa, Arabidopsis thaliana
  misc_feature (1)..(465): Ceres CDNA ID no. 12576899
  misc_feature (1)..(465): Sequence of endogenous gene to Ceres PROMOTER  YP0020
MGIMMMILGLLVIIVCLCTALLRWNQMRYSKKGLPPGTMGWPIFGETTEFLKQGPDFMKNQRLRYGSFFKSHILGCPTIVSMDAELNRYILMNESKGLVAGYPQSMLDILGTCNIAAVHGPSHRLMRGSLLSLISPTMMKDHLLPKIDDFMRNYLCGWDDLETVDIQEKTKHMAFLSSLLQIAETLKKPEVEEYRTEFFKLVVGTLSVPIDIPGTNYRSGVQARNNIDRLLTELMQERKESGETFTDMLGYLMKKEDNRYLLTDKEIRDQVVTILYSGYETVSTTSMMALKYLHDHPKALEELRREHLAIRERKRPDEPLTLDDIKSMKFTRAVIFETSRLATIVNGVLRKTTHDLELNGYLIPKGWRIYVYTREINYDTSLYEDPMIFNPWRWMEKSLESKSYFLLFGGGVRLCPGKELGISEVSSFLHYFVTKYRWEENGEDKLMVFPRVSAPKGYHLKCSPY

SEQ ID NO: 192 - DNA, 999 bp, Arabidopsis thaliana
  misc_feature (1)..(999): Predicted sequence of Ceres PROMOTER  YP0022
tagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataggcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaacttatatgagtaatagaaacgatcctaatattaggaattttagagattttctctcatctgtttcttaacttttcaatatttttattttttaaaattgtatgagtttctactaagaaactactgctggagttggtcttagcttcccaatgcttctccacctatatatatgcatatctccttcttaaaac

SEQ ID NO: 193 - DNA, 417 bp, Arabidopsis thaliana
  misc_feature (1)..(417): Experimental sequence of Ceres PROMOTER  YP0022
tagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaagg

SEQ ID NO: 194 - DNA, 1064 bp, Arabidopsis thaliana
  misc_feature: Encoded by SEQ ID NO: 191
  misc_feature (1)..(1064): Ceres CDNA ID no. 12711515
  misc_feature (1)..(1064): Sequence of endogenous gene to Ceres PROMOTER  YP0022
atctcacaccaaaacacaaagctctcatcttcttttagtttccaaactcacccccacaactttcatttctatcaaccaaacccaaatgggtccaagttcgagcctcaccaccatcgtggcgactgttcttcttgtgacattgttcggttcggcctacgcaagcaacttcttcgacgagtttgacctcacttggggtgaccacagaggcaaaatcttcaacggaggaaatatgctgtctttgtcgctggaccaggtttccgggtcaggtttcaaatccaaaaaagagtatttggtcggtcggatcgatatgcagctcaaacttgtcgccggaaactcggccggcaccgtcactgcttactacttgtcttcacaaggagcaacacatgacgagatagactttgagtttctaggtaacgagacagggaagccttatgttcttcacaccaatgtctttgctcaagggaaaggagacagagagcaacagttttatctctggttcgacccaaccaagaacttccacacttactccattgtctggagaccccaacacatcatattcttggtggacaatttacccattagagtgttcaacaatgcagagaagctcggcgttcctttcccaaagagtcaacccatgaggatctactctagcctgtggaatgcagacgattgggccacgagaggtggtctagtcaagactgactggtccaaggctcctttcacagcttactacagaggattcaacgctgcggcttgcacagcctcttcaggatgtgaccctaaattcaagagttcttttggtgatggtaaattgcaagtggcaaccgagctcaatgcttatggcaggaggagactcagatgggttcagaaatacttcatgatctataattattgctctgatctcaaaaggttccctcgtggattccctccagaatgcaagaagtccagagtctgatgaacacatattacctcatatttctctgcttgtttgatgcaattcttaaattcctctgttattccattgtacattgtcaagatcaataaagcattcctggtttcaaaat

SEQ ID NO: 195 - protein, 289 aa, Arabidopsis thaliana
  misc_feature (1)..(289): Ceres CDNA ID no. 12711515
  misc_feature (1)..(289): Sequence of endogenous gene to Ceres PROMOTER  YP0022
MGPSSSLTTIVATVLLVTLFGSAYASNFFDEFDLTWGDHRGKIFNGGNMLSLSLDQVSGSGFKSKKEYLVGRIDMQLKLVAGNSAGTVTAYYLSSQGATHDEIDFEFLGNETGKPYVLHTNVFAQGKGDREQQFYLWFDPTKNFHTYSIVWRPQHIIFLVDNLPIRVFNNAEKLGVPFPKSQPMRIYSSLWNADDWATRGGLVKTDWSKAPFTAYYRGFNAAACTASSGCDPKFKSSFGDGKLQVATELNAYGRRRLRWVQKYFMIYNYCSDLKRFPRGFPPECKKSRV

SEQ ID NO: 196 - DNA, 999 bp, Arabidopsis thaliana
  misc_feature (1)..(999): Predicted sequence of Ceres PROMOTER  YP0024
tgttaagggaaggtttgcacctaagaattttgaaggaattttgcggcgatatatcagtaagtaactttcttcttagtctcaaaatttaagttgccataaaagtatatcagtttggagttgttaacctcttgttttattatttctcagctgactacgtcatttgccttggttgcaagagcccagacaccattctctccaaggagaaccgtctcttctttctgagatgtgaaaaggtataagttaatctaattagtcctgatcttgatatgcattcctttgtttctgttttacagttttactttctgcgcaacaaagtaataaagtattttgtgtgtttgaatttgctaatgtgattaacgagtgggctacatggtttttgcagtgtggatctcaacgatctgtggctccgatcaaaacagggtttgttgctcgtgttagtcgcaggaagacttgagaaattagaaggtgaagtgaccttggtatggagtttggagctattctactgcttctgtatgagtttatgagttgaagaaatacttgtcttgttttttttattttgttttggaatatgattatgacttgacttttaaaatgggataggatcaaaaccttttactctgtcaggttcatgtggtcaccttgaaggttgatttagtaaatccatggacttcttttttgtgttaagattattcttagttcaaaattaatagactaatgatattaacgtccacaggcattgcgttcaacatctcaaattaaagcgtggaaggctcagaaagtccaatatacactatgtttatctacagttacaatcatactacaaaaaacaaataatgtatacggtttggtctaatatagccgcatacgatttagtatttaccaacaaaaaattggtctcaaaccaaaccgaacaattggtaattaacaattgttcttttggtcttgaaccgaaccaaaccgaactgaactatattaaccgaccgacttcgtcctttcctc

SEQ ID NO: 197 - DNA, 565 bp, Arabidopsis thaliana
  misc_feature (1)..(565): Experimental sequence of Ceres PROMOTER  YP0024
tgttaagggaaggtttgcacctaagaattttgaaggaattttgcggcgatatatcagtaagtaactttcttcttagtctcaaaatttaagttgccataaaagtatatcagtttggagttgttaacctcttgttttattatttctcagctgactacgtcatttgccttggttgcaagagcccagacaccattctctccaaggagaaccgtctcttctttctgagatgtgaaaaggtataagttaatctaattagtcctgatcttgatatgcattcctttgtttctgttttacagttttactttctgcgcaacaaagtaataaagtattttgtgtgtttgaatttgctaatgtgattaacgagtgggctacatggtttttgcagtgtggatctcaacgatctgtggctccgatcaaaacagggtttgttgctcgtgttagtcgcaggaagacttgagaaattagaaggtgaagtgaccttggtatggagtttggagctattctactgcttctgtatgagtttatgagttgaagaaatacttgtcttgttttttttattttgttttgg

SEQ ID NO: 198 - DNA, 1219 bp, Arabidopsis thaliana
  misc_feature: Encoded by SEQ ID NO: 195
  misc_feature (1)..(1219): Ceres CDNA ID no. 13614559
  misc_feature (1)..(1219): Sequence of endogenous gene to Ceres PROMOTER  YP0024
gatcaagaaaactcgtctcctacaaaaatcccagaagacaagagattggttcttcttttgcatcattcttacaaaatccccaaaatcattcgaaacccctgagtattctccttaactctaagaaataaatttctgaatggatgcatcgtcttcaccgtctccttccgaggaaagcttgaagcttgagcttgatgatcttcagaaacagctgaacaaaaagctgagattcgaagcatccgtttgttctattcataatcttctccgtgatcactactcttcttcctctccttctctccgcaaacagttctatatagttgtatctcgtgtcgctacggttcttaagacaagatatacagctactggattttgggttgctggactgagtcttttcgaagaggctgagcgacttgtctctgatgcttctgagaagaaacatttgaaatcttgcgttgctcaagctaaggagcagttaagcgaagtagataatcagccaacagagagctcacaaggttatctttttgagggacatcttacggttgatcgtgagccgccacagcctcagtggctagtacagcagaatctcatgtctgctttcgcttctatcgttggtggtgaatcctctaatggtcctactgaaaacactattggggaaactgctaacttgatgcaagaacttatcaatggtcttgacatgatcattccagatatactagatgatggtggaccaccaagagctccaccggcaagtaaagaagttgtagagaaactcccagtcattattttcaccgaggaattgcttaaaaagtttggagcagaggcagaatgttgcatctgcaaggagaatctagttattggcgacaagatgcaggaattgccatgcaagcacacatttcaccctccttgcctaaagccttggctggacgagcataactcttgccctatatgccgccatgaattaccaacagacgatcagaaatacgaaaactggaaagagagagagaaagaggccgaagaagagaggaagggcgcagagaatgctgtccgcggaggtgaatatatgtacgtttaaatttcaatcagttatggcacactcccattgtctttccttgaaacatctccgaattgttgttcatcattcacaattataaatcccattttacatatagattcaatgtcttttgtatgaaagcttataataacaacacagacttctttactt

SEQ ID NO: 199 - protein, 310 aa, Arabidopsis thaliana
  misc_feature (1)..(310): Ceres CDNA ID no. 13614559
  misc_feature (1)..(310): Sequence of endogenous gene to Ceres PROMOTER  YP0024
MDASSSPSPSEESLKLELDDLQKQLNKKLRFEASVCSIHNLLRDHYSSSSPSLRKQFYIVVSRVATVLKTRYTATGFWVAGLSLFEEAERLVSDASEKKHLKSCVAQAKEQLSEVDNQPTESSQGYLFEGHLTVDREPPQPQWLVQQNLMSAFASIVGGESSNGPTENTIGETANLMQELINGLDMIIPDILDDGGPPRAPPASKEVVEKLPVIIFTEELLKKFGAEAECCICKENLVIGDKMQELPCKHTFHPPCLKPWLDEHNSCPICRHELPTDDQKYENWKEREKEAEEERKGAENAVRGGEYMYV

SEQ ID NO: 200 - DNA, 999 bp, Arabidopsis thaliana
  misc_feature (1)..(999): Predicted sequence of Ceres PROMOTER  G0013
atcttgtgatacacaatttattactatttggtacattttgaagtatttgtttttgcatgatatatgacgttaatttgaactgatattagtcaatttatgggtacaaaagttgaaagtttagagcactatgttggatttattaaaaatgatatcatacaatggttcaatatatatatatttttttccacgtttttaataacatttttgtaaacaagtcttctactattgtctttattgttaatgagtttctagtacctaattaggaattttgaggatatacgatacattaatgagttacattatcccgaaaacaaaatcttgaaaacgaacaaagataatttggacattactcgttatgtatacgtatggaattggatagagccgttgaaccatcaagtgggtcttcaagtcaacgaactgaatttgattttacactcatgtacatcggccacaattttattcacacactactaacacctctggtgtccacttttttctttctctagattgatgtgttaagatttttgttgcaattcatttattcaggtatttttatatatatatatatataaattagaataaactaatttaaagaaagatatagcaattatgtttcacattttaacattctcaatcatttataaaactaatgtggtgatgaatggtatatatatatatatatatatatatatatatatatattttgttgtgaactaatggtaaatatttaaaataagacatacgtacataaatccacggactcttaaagtcatgatgcggttaataaatgttcacataacggtaaccaagtggctcaaaatcatgaaacaacgtcacataatttatcttataatgtggataattagtaccgcattatttgtaagaaaattaaattaattatagattcacagctaagaaaatacgaaaagacagctcaacacttttccacttctattccccactgtctataaactctgataaataatctctgatctctcc

SEQ ID NO: 201 - DNA, 402 bp, Arabidopsis thaliana
  misc_feature (1)..(402): Experimental sequence of Ceres PROMOTER  G0013
atcttgtgatacacaatttattactatttggtacattttgaagtatttgtttttgcatgatatatgacgttaatttgaactgatattagtcaatttatgggtacaaaagttgaaagtttagagcactatgttggatttattaaaaatgatatcatacaatggttcaatatatatatatttttttccacgtttttaataacatttttgtaaacaagtcttctactattgtctttattgttaatgagtttctagtacctaattaggaattttgaggatatacgatacattaatgagttacattatcccgaaaacaaaatcttgaaaacgaacaaagataatttggacattactcgttatgtatacgtatggaattggatagagccgttgaaccatcaagtgggt

SEQ ID NO: 202 - DNA, 1903 bp, Arabidopsis thaliana
  misc_feature: Encoded by SEQ ID NO: 199
  misc_feature (1)..(1903): Ceres CDNA ID no. 12679922
  misc_feature (1)..(1903): Sequence of endogenous gene to Ceres PROMOTER  G0013
atctaatatctctttctcaatttcggttccactttcctttcgtttgcaaaaacccatcccatcaaaaataaacaagagggcctaaagaagaatcctaaagactttacgggtcttgtttaggataaaagaaatgcctgccggtggattcgtcgtcggggatggccaaaaggcttatcccggcaaactcactccctttgttctcttcacttgcgttgttgctgccatgggcggtctcatcttcggatacgatatcggaatctccggtggtgtgacgtctatgccgtctttcctcaagcgattcttcccgtcggtgtatcggaaacaacaagaggacgcgtcaacgaaccagtactgtcagtacgatagcccgacgctaacgatgttcacatcgtctctatatctagcggcgctaatttcgtcgctggtggcttccaccgtgacaagaaagttcggacggcggctctcgatgctcttcggcggcatactcttctgcgccggagctctcatcaatggtttcgccaaacatgtttggatgctcatcgtcggtcgtatcttgcttggtttcggtatcggtttcgctaatcaggctgtgccactgtacctctctgagatggctccatacaaatacagaggagctttaaacattggtttccagctctcaattacaatcggaatcctcgtcgccgaagtgctaaactacttcttcgccaagatcaaaggcggttggggatggcggctcagtctcggaggcgcggtggttcctgccttgatcataaccatcggctccctcgtcctccctgacactcccaattcaatgatcgagcgtggccaacacgaagaagccaaaaccaagctcagacgaatccgtggtgtcgatgacgtcagccaagagtttgacgatttggtcgccgctagtaaagagtcgcagtcgatagagcacccgtggagaaacctcctccgccgcaagtaccgaccacatctcacaatggccgttatgattccgttctttcaacagctaaccggaatcaatgtgattatgttttacgctccggttttgttcaacaccattggtttcacgaccgatgcttctctcatgtccgctgtggtcactggctcggttaacgtggccgctacgcttgtttctatctacggtgttgacagatggggacgtcggtttctctttcttgaaggtggtacacaaatgcttatatgccaggctgtggttgcagcttgcataggggccaagtttggggtagacgggacccctggtgagctaccaaagtggtatgctatagtggttgtaacgttcatttgcatctatgtggcgggttttgcgtggtcgtggggcccactagggtggttagtaccgagtgaaatcttcccgttggagataaggtcggcggcgcagagtatcaccgtgtccgtgaacatgatcttcacgttcattatcgcgcaaatcttcttgacgatgctttgtcatttgaagtttgggttattccttgttttcgcctttttcgtggtggtgatgtcgatctttgtatacattttcttgccggagacgaaagggattccgatagaggagatgggtcaagtgtggaggtcacactggtattggtcaaggtttgtggaggatggtgagtatgggaatgcgcttgagatgggcaagaacagtaaccaagctggaacgaagcatgtttgatttatcattgtttttaatgagagttttaagaaagaaagaaaaaagatttgtaatttctaatgtcgtaaaggaaaaagtgtattagcctagatatttattggtgtttatataattcaataccacatgaagaaattatgcatatgattcttcgttaattgtctgtaattgttatactctttacttaaaccaagtgttttctctttg

SEQ ID NO: 203 - protein, 522 aa, Arabidopsis thaliana
  misc_feature (1)..(522): Ceres CDNA ID no. 12679922
  misc_feature (1)..(522): Sequence of endogenous gene to Ceres PROMOTER  G0013
MPAGGFVVGDGQKAYPGKLTPFVLFTCVVAAMGGLIFGYDIGISGGVTSMPSFLKRFFPSVYRKQQEDASTNQYCQYDSPTLTMFTSSLYLAALISSLVASTVTRKFGRRLSMLFGGILFCAGALINGFAKHVWMLIVGRILLGFGIGFANQAVPLYLSEMAPYKYRGALNIGFQLSITIGILVAEVLNYFFAKIKGGWGWRLSLGGAVVPALIITIGSLVLPDTPNSMIERGQHEEAKTKLRRIRGVDDVSQEFDDLVAASKESQSIEHPWRNLLRRKYRPHLTMAVMIPFFQQLTGINVIMFYAPVLFNTIGFTTDASLMSAVVTGSVNVAATLVSIYGVDRWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVVVMSIFVYIFLPETKGIPIEEMGQVWRSHWYWSRFVEDGEYGNALEMGKNSNQAGTKHV

SEQ ID NO: 204 - DNA, 999 bp, Arabidopsis thaliana
  misc_feature (1)..(999): Predicted sequence of Ceres PROMOTER  YP0028
tagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcaggacttttttctacttaatgaaacctccaaactatctaactaatacactcccatgtagaataaagaaaattatataagatattgttgatattttgtaactagaaaatatatttgctctgtaatttttcgtaagttaaatcaacatttttcagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaaaaaaaaa

SEQ ID NO: 205 - DNA, 1031 bp, Arabidopsis thaliana
  misc_feature (1)..(1031): Experimental sequence of Ceres PROMOTER  YP0028
gtcagtgaagtcgattggtagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcatcttctttttgtcaggacttttttctacttaatgaaacctccaaactatctaactaatacactcccatgtagaataaagaaaattatataagatattgttgatattttgtaactagaaaatatatttgctctgtaatttttcgtaagttaaatcaacattttaaagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaaaaaaaaa

SEQ ID NO: 206 - DNA, 1890 bp, Arabidopsis thaliana
  misc_feature: Encoded by SEQ ID NO: 203
  misc_feature (1)..(1890): Ceres CDNA ID no. 12561142
  misc_feature (1)..(1890): Sequence of endogenous gene to Ceres PROMOTER  YP0028
atggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaaagggttgtttttattttttcataaggaattcgcaagttcgatttttacttgagatggtttcacacgtgtggtgatggttgatgatgggctttgagattgagagagttacgattatgatgataatgcagttcataatatgaatttggattttggaataggactaattaagtaattctgatcattgaggtgggtatcaaggttcatacaattcgtgattttttgttttgtctttggtatttattaattttaaaaatccattttggaatgaaatttgtgattacttttgtttatccg

SEQ ID NO: 207 - protein, 531 aa, Arabidopsis thaliana
  misc_feature (1)..(531): Ceres CDNA ID no. 12561142
  misc_feature (1)..(531): Sequence of endogenous gene to Ceres PROMOTER  YP0028
MDTLFRLVSLQQQQQSDSIITNQSSLSRTSTTTTGSPQTAYHYNFPQNDVVEECFNFFMDEEDLSSSSSHHNHHNHNNPNTYYSPFTTPTQYHPATSSTPSSTAAAAALASPYSSSGHHNDPSAFSIPQTPPSFDFSANAKWADSVLLEAARAFSDKDTARAQQILWTLNELSSPYGDTEQKLASYFLQALFNRMTGSGERCYRTMVTAAATEKTCSFESTRKTVLKFQEVSPWATFGHVAANGAILEAVDGEAKIHIVDISSTFCTQWPTLLEALATRSDDTPHLRLTTVVVANKFVNDQTASHRMMKEIGNRMEKFARLMGVPFKFNIIHHVGDLSEFDLNELDVKPDEVLAINCVGAMHGIASRGSPRDAVISSFRRLRPRIVTVVEEEADLVGEEEGGFDDEFLRGFGECLRWFRVCFESWEESFPRTSNERLMLERAAGRAIVDLVACEPSDSTERRETARKWSRRMRNSGFGAVGYSDEVADDVRALLRRYKEGVWSMVQCPDAAGIFLCWRDQPVVWASAWRPT

SEQ ID NO: 208 - DNA, 999 bp, Arabidopsis thaliana
  misc_feature (1)..(999): Predicted sequence of Ceres PROMOTER  YP0030
tacttgcctcatgtgtttggatacgagattactgaacgttgtggtgtattttatagtcatgggtttgttaattgttatcatgcttgcctacttaactagcgtaattatgtttttttgtactacctcggaagtagctattttgtcgcttattgacaacgagatactttaagatgttccacatccacgtcgtaatcggttgatcgaatggtgcctaatagatcaaagttatcctcaacaaatatcgatgtgtagtatatacgtgaatatatagtagtctcttgcatgcatatcatatacaacttaaatactctttttgtttcaaaataaataatgttttaggaaaaagattattgtgtcaaattaagtgttggtctattcatccaaacaagaaagaaaaaaaatacgaatttgttttatatatcattgacgaacaatgtttagctaataataaataattatttatttataaaaattaaaagttagatagtttcttaatttaggtgcatataagttctttaacaaaaaaaacatttaggtgcataagtcttaaatatcaaatattttggaacagtaattttatgtataacttttttcgtacctatcttcacaccgcataaattgccaaagtcaaccttttgatatttcattcctcacaaaaccatattaatttatacacctcaatattgtttaatagtattatcatgttggctttcgctgaatttatcaaagtgcaacatgttttatcttacaaaaaaataaaaagaaattcacgttgtgtgatcttgagagttgacttttaaatatatcacaacttatataaatacgcagcaacattccaatctctcaagaaaatctacagttcctccaaataataataccctccctctaaggtttaaaactatacctcattaacacattaagaagctagtcattacttcatttctatattttaaataatgtttattgataacaattgcaggcaactaattttcagcaatc

SEQ ID NO: 209 - DNA, 1075 bp, Arabidopsis thaliana
  misc_feature (1)..(1075): Experimental sequence of Ceres PROMOTER  YP0030
aggtcagtgaagtcgattggtacttgcctcatgtgtttggatacgagattactgaacgttgtggtgtattttatagtcatgggtttgttaattgttatcatgcttgcctacttaactagcgtaattatgtttttttgtactacctcggaagtagctattttgtcgcttattgacaacgagatactttaagatgttccacatccacgtcgtaatcggttgatcgaatggtgcctaatagatcaaagttatcctcaacaaatatcgatgtgtagtatatacgtgaatatatagtagtctcttgcatgcatatcatatacaacttaaatactctttttgtttcaaaataaataatgttttaggaaaaagattattgtgtcaaattaagtgttggtctattcatccaaacaagaaagaaaaaaaatacgaatttgttttatatatcattgacgaacaatgtttagctaataataaataattatttatttataaaaattaaaagttagatagtttcttaatttaggtgcatataagttctttaacaaaaaaaacatttaggtgcataagtcttaaatatcaaatattttggaacagtaattttatgtataacttttttcgtacctatcttcacaccgcataaattgccaaagtcaaccttttgatatttcattcctcacaaaaccatattaatttatacacctcaatattgtttaatagtattatcatgttggctttcgctgaatttatcaaagtgcaacatgttttatcttacaaaaaaataaaaagaaattcacgttgtgtgatcttgagagttgacttttaaatatatcacaacttatataaatacgcagcaacattccaatctctcaagaaaatctacagttcctccaaataataataccctccctctaaggtttaaaactatacctcattaacacattaagaagctagtcattacttcatttctatattttaaataatgtttattgataacaattgcaggcaactaattttcagcaatcaccattgcactgggatccaacaatgtcctccgactcgtccaagatcaagaggaagc

SEQ ID NO: 210 - DNA, 2311 bp, Arabidopsis thaliana
  misc_feature: Encoded by SEQ ID NO: 207
  misc_feature (1)..(2311): Ceres CDNA ID no. 12664333
  misc_feature (1)..(2311): Sequence of endogenous gene to Ceres PROMOTER  YP0030
attccaatctctcaagaaaatctacagttcctccaaataataataccctccctctaaggcaactaattttcagcaatcatgtccgggactattaatcccccggacggaggagggtccggtgcaagaaacccaccagtcgttcgtcagagagtgctagctcctccgaaagcgggtttactaaaggacatcaagtccgtggttgaagaaactttcttccatgatgctccgcttagggatttcaagggccaaaccccagctaaaaaagcgttgctcgggatccaggctgtcttcccgatcatcgggtgggccagagaatacactcttcgcaaatttagaggtgatctcatcgccggtctcaccattgctagtctttgtatccctcaggatatcggatatgcaaaactcgcgaatgtcgatccgaaatacggactttattcgagtttcgtgccaccgctgatttacgcgggcatggggagttctagggatattgcgataggaccagtcgctgtggtgtctcttcttgtgggaactttgtgccaggccgtgatcgacccaaagaaaaacccggaggattatctccgacttgtcttcactgccactttctttgctggcattttccaagccggcctcggatttctacggttgggattcttgatagactttctgtcgcatgcggccgtggttgggttcatgggaggagcagccatcacaatcgctctccaacagcttaagggctttcttggcatcaaaacatttaccaagaaaactgatattgtttctgtcatgcactccgtattcaaaaacgctgagcatgggtggaattggcaaactatagtcattggcgccagtttcttgacctttcttctcgtcaccaaattcattgggaagagaaacaggaaactattttgggttccggcaattgcgcctcttatttcagtcattatctctaccttctttgtcttcatttttcgtgctgataaacaaggagtccaaattgtgaaacatatagatcaaggaatcaatccgatttccgttcataagattttcttctccggaaaatatttcaccgaaggaatccgaatcggaggcattgcgggtatggtcgccttaacggaggctgtagcgattgcaagaacatttgcggcaatgaaagactatcaaattgatggaaacaaagagatgattgccctagggactatgaacgtcgtcggttcaatgacctcttgttacattgccacgggttcgttttcgcgatctgccgtgaacttcatggcgggagtcgaaacggcggtttcaaacatagttatggccatagttgtagctctaaccttagagttcatcacaccactcttcaagtacactccaaatgctatcctcgcggccatcattatatcggctgtcctcggtcttatcgatattgacgcagcgattctcatatggaggatcgataaactcgacttcttggcttgcatgggagctttcttaggagtcatcttcatctcggttgagatcggtctcttgatcgctgtggtgatctcttttgcaaagatattgcttcaagtgacgagaccaagaaccacggttctagggaagctgccaaattcgaatgtatatcggaacactctacagtatccggacgctgcccaaattcccggaatcttgatcatccgtgttgactcggccatctacttttccaactccaactatgtccgagaaagggcatcaagatgggtgcgagaggagcaagaaaatgctaaggaatatggcatgccggcaatcagatttgtgattattgagatgtcaccggttaccgatatcgataccagtggtatccactccatcgaagaacttctcaagagcctcgagaagcaagaaattcagttgattctagcaaatccaggaccagtggtgattgagaaactttatgcttcaaagttcgtcgaggagattggagagaaaaatatcttccttactgttggcgacgcggtcgcagtttgttctacggaagtggctgagcaacaaacttaatatcgtctattcatatacataaacacatccatatatgtatgtgtatatatatatgaaagaaactaatttaagaactatgggttattttcatttttttgagatgatatgatattatgtgtgtaatatatgcatgattgttgaatttgtttggttcacacaatggtgagatgggaacaaagtcgaacgtttgacttttatttttattttttaatctttcaaatgttattttctcgtgatttgtgtttcgtttgagatgatgaataaattgtattttcaacttata

SEQ ID NO: 211 - protein, 649 aa, Arabidopsis thaliana
  misc_feature (1)..(649): Ceres CDNA ID no. 12664333
  misc_feature (1)..(649): Sequence of endogenous gene to Ceres PROMOTER  YP0030
MSGTINPPDGGGSGARNPPVVRQRVLAPPKAGLLKDIKSVVEETFFHDAPLRDFKGQTPAKKALLGIQAVFPIIGWAREYTLRKFRGDLIAGLTIASLCIPQDIGYAKLANVDPKYGLYSSFVPPLIYAGMGSSRDIAIGPVAVVSLLVGTLCQAVIDPKKNPEDYLRLVFTATFFAGIFQAGLGFLRLGFLIDFLSHAAVVGFMGGAAITIALQQLKGFLGIKTFTKKTDIVSVMHSVFKNAEHGWNWQTIVIGASFLTFLLVTKFIGKRNRKLFWVPAIAPLISVIISTFFVFIFRADKQGVQIVKHIDQGINPISVHKIFFSGKYFTEGIRIGGIAGMVALTEAVAIARTFAAMKDYQIDGNKEMIALGTMNVVGSMTSCYIATGSFSRSAVNFMAGVETAVSNIVMAIVVALTLEFITPLFKYTPNAILAAIIISAVLGLIDIDAAILIWRIDKLDFLACMGAFLGVIFISVEIGLLIAVVISFAKILLQVTRPRTTVLGKLPNSNVYRNTLQYPDAAQIPGILIIRVDSAIYFSNSNYVRERASRWVREEQENAKEYGMPAIRFVIIEMSPVTDIDTSGIHSIEELLKSLEKQEIQLILANPGPVVIEKLYASKFVEEIGEKNIFLTVGDAVAVCSTEVAEQQT

SEQ ID NO: 212 - DNA, 999 bp, Arabidopsis thaliana
  misc_feature (1)..(999): Predicted sequence of Ceres PROMOTER  YP0054
agcttattttgttctattctatcgtatttgattcttctttcgttttttttttgtttgacttaagaaaccgattgtttatagtagtaaacatttgtttttaatgttgctcgattccagtgcacatgtccaggctagacacttgtcgttataaaggttgctttggttcaatattgatccactagagatgttacaactattgttgacatctgagattgtgtgataagaaaatatgaaactggatttagtgaaagttacaatatataatcatacatcatagataggaaataaggaaatgtcagatatacttgaagaatacatcaaatagacaaggtcctttttcttattgtcgactattatagagccgtacagaaccttttcacgtctttagtaattagtacattctccatttcggctctctcttattttttttccatctcttttacttctccaaataataacaataaaagcttcgattttgtgtgtgtttgtatttacatcttgacatcgatattcttttcatcaattttttaccaaaaatgtaataaaaacaaaaaaaaaccaacgctgaacacagacatggtttctccatccgtttatattcatcgtttgtatgtttacttaacaacttatttcaaaatagtacatatcatggttgtgtttttaaaaaaagtatacagaacagaaaagcacatggtagacaaaataatgaagccaaaattaatacaaagaagaagttcaacttgtatttattaacacattttctttccttgtcaaagacatgcaaattggttttgttttcttattcccattttttttttataataaaaagaagaagagtaaaacaaaaaaactatcatttcttcttatcgcaaaactcttatctaagcaagaaaccgacaaaacctatatctacatatattctcatcaacatctcttgagacatattcattttggttaaagcaaaagattttaagagagaaagggggagaagtgagagag

SEQ ID NO: 213 - DNA, 454 bp, Arabidopsis thaliana
  misc_feature (1)..(454): Experimental sequence of Ceres PROMOTER  YP0054
ctgatctctagtccagtcgattggagcttattttgttctattctatcgtatttgattcttctttcgttttttttttgtttgacttaagaaaccgattgtttatagtagtaaacatttgtttttaatgttgctcgattccagtgcacatgtccaggctagacacttgtcgttataaaggttgctttggttcaatattgatccactagagatgttacaactattgttgacatctgagattgtgtgataagaaaatatgaaactggatttagtgaaagttacaatatataatcatacatcatagataggaaataaggaaatgtcagatatacttgaagaatacatcaaatagacaaggtcctttttcttattgtcgactattatagagccgtacagaaccttttcacgtctttagtaattagtacattctccatttcggctctctcttatttttttt

SEQ ID NO: 214 - DNA, 1591 bp, Arabidopsis thaliana
  misc_feature: Encoded by SEQ ID NO: 211
  misc_feature (1)..(1591): Ceres CDNA ID no. 12348737
  misc_feature (1)..(1591): Sequence of endogenous gene to Ceres PROMOTER  YP0054
attttggttaaagcaaaagattttaagagagaaagggggagaagtgagagagatggagcataagagaggacatgtattagcagtgccgtacccaacgcaaggacacatcacaccattccgccaattctgcaaacgacttcacttcaaaggtctcaaaaccactctcgctctcaccactttcgtcttcaactccatcaatcctgacctatccggtccaatctccatagccaccatctccgatggctatgaccatgggggtttcgagacagctgactccatcgacgactacctcaaagactttaaaacttccggctcgaaaaccattgcagacatcatccaaaaacaccagactagtgataaccccatcacttgtatcgtctatgatgctttcctgccttgggcacttgacgttgctagagagtttggtttagttgcgactcctttctttacgcagccttgtgctgttaactatgtttattatctttcttacataaacaatggaagcttgcaacttcccattgaggaattgccttttcttgagctccaagatttgccttctttcttctctgtttctggctcttatcctgcttactttgagatggtgcttcaacagttcataaatttcgaaaaagctgatttcgttctcgttaatagcttccaagagttggaactgcatgagaatgaattgtggtcgaaagcttgtcctgtgttgacaattggtccaactattccatcaatttacttagaccaacgtatcaaatcagacaccggctatgatcttaatctctttgaatcgaaagatgattccttctgcattaactggctcgacacaaggccacaagggtcggtggtgtacgtagcattcggaagcatggctcagctgactaatgtgcagatggaggagcttgcttcagcagtaagcaacttcagcttcctgtgggtggtcagatcttcagaggaggaaaaactcccatcagggtttcttgagacagtgaataaagaaaagagcttggtcttgaaatggagtcctcagcttcaagttctgtcaaacaaagccatcggttgtttcttgactcactgtggctggaactcaaccatggaggctttgaccttcggggttcccatggtggcaatgccccaatggactgatcaaccgatgaacgcaaagtacatacaagatgtgtggaaggctggagttcgtgtgaagacagagaaggagagtgggattgccaagagagaggagattgagtttagcattaaggaagtgatggaaggagagaggagcaaagagatgaagaagaacgtgaagaaatggagagacttggctgtcaagtcactcaatgaaggaggttctacggatactaacattgatacatttgtatcaagggttcagagcaaataggtaactcacatacagtagcaaaggtccttctataatatcttgttttgtacgtctttcattcagcataatcttttgttgacttttcttatgttgtatgttcaaatccccatattgcttcttgttgtatgttcaaatccccatattgcttcttgttgacaataataataataaaaacaatgcaactttacc

SEQ ID NO: 215 - protein, 449 aa, Arabidopsis thaliana
  misc_feature (1)..(449): Ceres CDNA ID no. 12348737
  misc_feature (1)..(449): Sequence of endogenous gene to Ceres PROMOTER  YP0054
MEHKRGHVLAVPYPTQGHITPFRQFCKRLHFKGLKTTLALTTFVFNSINPDLSGPISIATISDGYDHGGFETADSIDDYLKDFKTSGSKTIADIIQKHQTSDNPITCIVYDAFLPWALDVAREFGLVATPFFTQPCAVNYVYYLSYINNGSLQLPIEELPFLELQDLPSFFSVSGSYPAYFEMVLQQFINFEKADFVLVNSFQELELHENELWSKACPVLTIGPTIPSIYLDQRIKSDTGYDLNLFESKDDSFCINWLDTRPQGSVVYVAFGSMAQLTNVQMEELASAVSNFSFLWVVRSSEEEKLPSGFLETVNKEKSLVLKWSPQLQVLSNKAIGCFLTHCGWNSTMEALTFGVPMVAMPQWTDQPMNAKYIQDVWKAGVRVKTEKESGIAKREEIEFSIKEVMEGERSKEMKKNVKKWRDLAVKSLNEGGSTDTNIDTFVSRVQSK

SEQ ID NO: 216 - DNA, 999 bp, Arabidopsis thaliana
  misc_feature (1)..(999): Predicted sequence of Ceres PROMOTER  YP0025
gtctcaccatgagccaatgaaaagaaatagtaatccaggtgattgtttctctttgatgtctcactttctaatagctagtctctaaaagaacctttgttttagtgaattctaatatagtaggggttttgcagcgcaattttcttcagcaccgaagaaaagtagattgaagatcggagagtcctctgctttctttacatatgtcaaatctactgtccttagaactaacggtcaggatcctcctcttgtcgatggaaatggctcacttcatcttcatcggggtttggcggagaagtttcaagtggtggctagtgaagggatcaacaacaccaaacaagcacgcagagcaacaccaaaatctactgtccttagaactaacggtcaggatcctcctcttgtcaatggaaatggctcacatcatcttcatcggggtgcggcggaaaagtttcaagtggtggctagtgaagggatcaacaacaccaaacaagcacacagaagtagagggaccgagcaataccattctcaaggagagaccttgcagaatggcgccagctatccacattcccttgagcggtcacgcacgcttcccacatcaatggaatctcatggtaggaactaccaagagggcaatatgaatattccccaagttgctatgaacagaagtaaagattcgtctcaagttgatggatcgggtttctctgcaccaaatgcctatccttactatatgcatggggtcatgaaccaagttatgatgcaatcagcagccatgatgcctcaatatggtcatcaaattcctcattgccaaccaaatcatccgaatggaatgacgggatatccttactaccaccacccaatgaacacatctttgcagcatagtcagatgtctttacagaatggtcagatgtctatggttcatcattcttggtcaccggcaggaaatccgccttctaatgaggtgagggtaaataaacttgacagaagagaggaagctctgctgaaatt

SEQ ID NO: 217 - DNA, 463 bp, Arabidopsis thaliana
  misc_feature (1)..(463): Experimental sequence of Ceres PROMOTER  YP0025
gtcagtgaagtcgattgggtctcaccatgagccaatgaaaagaaatagtaatccaggtgattgtttctctttgatgtctcactttctaatagctagtctctaaaagaacctttgttttagtgaattctaatatagtaggggttttgcagcgcaattttcttcagcaccgaagaaaagtagattgaagatcggagagtcctctgctttctttacatatgtcaaatctactgtccttagaactaacggtcaggatcctcctcttgtcgatggaaatggctcacttcatcttcatcggggtttggcggagaagtttcaagtggtggctagtgaagggatcaacaacaccaaacaagcacgcagagcaacaccaaaatctactgtccttagaactaacggtcaggatcctcctcttgtcaatggaaatggctcacatcatcttcatcggggtgcggcggaaaagttt

SEQ ID NO: 218 - DNA, 2635 bp, Arabidopsis thaliana
  misc_feature: Encoded by SEQ ID NO: 215
  misc_feature (1)..(2635): Ceres CDNA ID no. 12322657
  misc_feature (1)..(2635): Sequence of endogenous gene to Ceres PROMOTER  YP0025
agtcttctttctcttctcactcttcttgtcggaaattcaccttctctctctctcctcctcatctcaccgccggcgttacgccggatctccggtgacttttgttgagcttttttgttgattcatgattcgatatagagaaaaaagaatttcctatttcagctctttgttcttagatttatctttttgtttgttcttatggataaaggattaggttgggggattaaaagagtagtttttgtttggttgtgagattacttgactttgttaaggggataaattaggcgactttgtagggacactgtaccgaaaaaccctagttctgatttggccatggaagtatcatagcacttactattgtcggctttacttcttctacttttgtataatccttttttttcttaggttctgtgattagatattttttttgtgtgggtttagttgttaatctgatcatggatttgaacggtgagtgtaaaggaggagatgggtttattgatagaagcagagtcaggattttgctttgtgacaatgattccacgagtttgggagaggtttttactctcctttcagagtgttcttatcaagtgactgcagtgaaatcagcaaggcaggtgattgatgcacttaatgcagagggacctgatatcgatataatactggcggaaattgatctcccaatggctaagggtatgaagatgctgaggtacatcacacgagacaaagatcttcgcagaatccctgtgataatgatgtcgaggcaagacgaagtccctgtcgttgtaaagtgcttgaagctaggtgcagctgactaccttgtgaagcctcttcgcaccaacgagcttctgaacttgtggacacacatgtggagaagaagacgcatgctaggacttgctgagaagaatatgttgagctatgattttgatcttgtgggatctgatcaaagtgatccaaacacaaatagtaccaacctgttctctgacgacacagatgatagaagtcttaggtccaccaacccacagagaggaaatttaagtcaccaggaaaatgagtggtctgttgctactgctcctgttcatgctcgtgatggtggtcttggtgctgatggaacagccacttcttctcttgctgttactgctatagagcctccattggatcatcttgctgggtctcaccatgagccaatgaaaagaaatagtaatccagcgcaattttcttcagcaccgaagaaaagtagattgaagatcggagagtcctctgctttctttacatatgtcaaatctactgtccttagaactaacggtcaggatcctcctcttgtcgatggaaatggctcacttcatcttcatcggggtttggcggagaagtttcaagtggtggctagtgaagggatcaacaacaccaaacaagcacgcagagcaacaccaaaatctactgtccttagaactaacggtcaggatcctcctcttgtcaatggaaatggctcacatcatcttcatcggggtgcggcggaaaagtttcaagtggtggctagtgaagggatcaacaacaccaaacaagcacacagaagtagagggaccgagcaataccattctcaaggagagaccttgcagaatggcgccagctatccacattcccttgagcggtcacgcacgcttcccacatcaatggaatctcatggtaggaactaccaagagggcaatatgaatattccccaagttgctatgaacagaagtaaagattcgtctcaagttgatggatcgggtttctctgcaccaaatgcctatccttactatatgcatggggtcatgaaccaagttatgatgcaatcagcagccatgatgcctcaatatggtcatcaaattcctcattgccaaccaaatcatccgaatggaatgacgggatatccttactaccaccacccaatgaacacatctttgcagcatagtcagatgtctttacagaatggtcagatgtctatggttcatcattcttggtcaccggcaggaaatccgccttctaatgaggtgagggtaaataaacttgacagaagagaggaagctctgctgaaattcagacgtaaaaggaaccaacgttgttttgataagaagattaggtatgtgaataggaaacgccttgctgagaggagaccccgcgttaagggtcagtttgttaggaagatgaacggcgtgaatgttgatttaaatggacagcctgactctgctgactatgatgacgaggaagaggaggaagaagaagaagaagaggagaaccgggattcatctcctcaggatgatgctttgggaacttgaagatacaccaagaactgaaaaccgttgtgttatacgtatttgcttgcatcttatcaaacaacagaagatgttgatcgactgacacgaaaaagatgatactgctacagccaaaaaaacatcgaatatcgagttgtctctaaggcaatgttggctcttgcggctcaactttttgacagagcattgaaaagctctcattgggtttagcttagttcgttgataaacatataatgtattttatcatgttcactcacattctctcagtaagtactcagatgtattaacctttcttctccttccagtatcatttacttgaatcttgtttttcc

SEQ ID NO: 219 - protein, 618 aa, Arabidopsis thaliana
  misc_feature (1)..(618): Ceres CDNA ID no. 12322657
  misc_feature (1)..(618): Sequence of endogenous gene to Ceres PROMOTER  YP0025
MDLNGECKGGDGFIDRSRVRILLCDNDSTSLGEVFTLLSECSYQVTAVKSARQVIDALNAEGPDIDIILAEIDLPMAKGMKMLRYITRDKDLRRIPVIMMSRQDEVPVVVKCLKLGAADYLVKPLRTNELLNLWTHMWRRRRMLGLAEKNMLSYDFDLVGSDQSDPNTNSTNLFSDDTDDRSLRSTNPQRGNLSHQENEWSVATAPVHARDGGLGADGTATSSLAVTAIEPPLDHLAGSHHEPMKRNSNPAQFSSAPKKSRLKIGESSAFFTYVKSTVLRTNGQDPPLVDGNGSLHLHRGLAEKFQVVASEGINNTKQARRATPKSTVLRTNGQDPPLVNGNGSHHLHRGAAEKFQVVASEGINNTKQAHRSRGTEQYHSQGETLQNGASYPHSLERSRTLPTSMESHGRNYQEGNMNIPQVAMNRSKDSSQVDGSGFSAPNAYPYYMHGVMNQVMMQSAAMMPQYGHQIPHCQPNHPNGMTGYPYYHHPMNTSLQHSQMSLQNGQMSMVHHSWSPAGNPPSNEVRVNKLDRREEALLKFRRKRNQRCFDKKIRYVNRKRLAERRPRVKGQFVRKMNGVNVDLNGQPDSADYDDEEEEEEEEEEENRDSSPQDDALGT

SEQ ID NO: 220 - DNA, 999 bp, Arabidopsis thaliana
  misc_feature (1)..(999): Predicted sequence of Ceres PROMOTER  YP0050
tacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccataaaacatcaccacctctgttgtcatctcatgaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaacc

SEQ ID NO: 221 - DNA, 458 bp, Arabidopsis thaliana
  misc_feature (1)..(458): Experimental sequence of Ceres PROMOTER  YP0050
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaaccc

SEQ ID NO: 222 - DNA, 1300 bp, Arabidopsis thaliana
  misc_feature: Encoded by SEQ ID NO: 219
  misc_feature (1)..(1300): Ceres CDNA ID no. 4909806
  misc_feature (1)..(1300): Sequence of endogenous gene to Ceres PROMOTER  YP0050
gtcttggcatcctcgtcctcttcagcaaaactcgtctctcttgcactccaaaaagcaaccatgtctgcttttgtcggcaaatacgcagatgagctgataaagacggctaagtacattgccacaccgggaaagggcattttggcagcagacgagagcacgggaactattgggaaacgattcgccagcatcaatgttgagaacattgagtccaaccgccaagctctccgtgagctcctcttcacgtcccctggcactttcccttgcctctccggtgttatcctcttcgaggaaaccctctaccagaaaaccacggatggcaaacccttcgttgagctcctcatggaaaacggagttatccctggaatcaaagtggacaagggtgtggttgatctagcaggaaccaatggcgagaccactactcagggtctagattcacttggtgcacgttgccaggagtattacaaggcaggagctcggtttgcaaaatggcgtgcagtcctcaagattggggccaccgagccaagcgagctctctatccaagagaacgccaaggggctagcccgctatgccatcatctgccaggagaatggactcgtcccaatcgtcgagccagaggtactgaccgacgggagccatgacatcaagaaatgtgcagcggtgaccgagaccgttcttgctgccgtgtacaaggccttgaacgaccaccatgtcctcctcgaaggcactctgcttaaaccgaacatggtcactcccggctctgacagcccaaaggttgcaccggaagtgatagcggaatacacagtgactgctctgcgccgcacagtcccacctgcagttccaggaatcgtgttcctctcaggcggacagagtgaagaggaagcaacactaaatctgaacgcaatgaacaagctcgatgtgttgaagccatggactctcactttctcatttggccgagccctccaacaaagcactctcaaggcttgggcaggtaagacagagaatgtagccaaagctcaggccactttcctgaccaggtgcaagggtaactcggacgctaccctcgggaaatacaccggcggggcttctggtgactcggccgcctctgagagcttgtatgaggaaggatacaagtattaggagcgtttaaatacgggtgtcgccttttatacgatttgaatatatgtcaaatgtttcgtaggcgtttaactgtttaaatttttatcgatttggtttagcgtctgtgtaatgttcttaaactgtgttgtgttttttgtgatggtttctataatattttcgcgcc

SEQ ID NO: 223 - protein, 358 aa, Arabidopsis thaliana
  misc_feature (1)..(358): Ceres CDNA ID no. 4909806
  misc_feature (1)..(358): Sequence of endogenous gene to Ceres PROMOTER  YP0050
MSAFVGKYADELIKTAKYIATPGKGILAADESTGTIGKRFASINVENIESNRQALRELLFTSPGTFPCLSGVILFEETLYQKTTDGKPFVELLMENGVIPGIKVDKGVVDLAGTNGETTTQGLDSLGARCQEYYKAGARFAKWRAVLKIGATEPSELSIQENAKGLARYAIICQENGLVPIVEPEVLTDGSHDIKKCAAVTETVLAAVYKALNDHHVLLEGTLLKPNMVTPGSDSPKVAPEVIAEYTVTALRRTVPPAVPGIVFLSGGQSEEEATLNLNAMNKLDVLKPWTLTFSFGRALQQSTLKAWAGKTENVAKAQATFLTRCKGNSDATLGKYTGGASGDSAASESLYEEGYKY

SEQ ID NO: 224 - DNA, 999 bp, Arabidopsis thaliana
  misc_feature (1)..(999): Predicted sequence of Ceres PROMOTER  YP0040
cccatcacatgtaacatcattgggctatccaaaagtctaaccaataatgtcaatctataaaccacattaagtagttcattttttttgtagtcgtgtttagcttgttaaacctcataaaatatgttttcacttacgttaacaaaacaaatatcttcacgaaaaaaaataaaataaaatatctttttgataccgaaaaaataaaataaaataattttccctttcgatcataaaatgcgtagataagagaaactgtgtttgaggctccatttcatgttcacctaccagtctaccacgtcatttctcaaagacgcaaattttctaattagggatgtgctctttttacatatagatcaatatcctaaaaaaatttaagatattcatattttcgtacatatatatcgagtttcccgaaaaatccataaaatgggtataatgatagtcctttttcacctttaataataatttctgaacaaaattatatcataataaacttgtgattttatacaaaatttatttgtatatataattttactaaccaacgtgaacgataaaaataatattctcataaaatgttgattaaaaattacttaaaataaataattatttaggattatgtattagtagtactcgaaccatttttttagttatctgcatgaagaccctaatttttcacatatatcgaaactaaaactttggatatacactgtaatttgaaaacgcttggaacggataatgtagttacctcacaagattttgtacatccctgacattttatattcattaaagtgtgtttttttcttcagaaaagaaaacactttttttttttgtgcttttagtttaaattaacaaaaaaatggacaccatgagattccactaactcatgtgtatataacattagggaagcagtcaattcatttcagcatccacacacactttgaatgctcaatcaaagcttcttcatagttaaacttccacacaacgtcaaaactcgagaagaag

SEQ ID NO: 225 - DNA, 611 bp, Arabidopsis thaliana
  misc_feature (1)..(611): Experimental sequence of Ceres PROMOTER  YP0040
cccatcacatgtaacatcattgggctatccaaaagtctaaccaataatgtcaatctataaaccacattaagtagttcattttttttgtagtcgtgtttagcttgttaaacctcataaaatatgttttcacttacgttaacaaaacaaatatcttcacgaaaaaaaataaaataaaatatctttttgataccgaaaaaataaaataaaataaaataattttccctttcgatcataaaatgcgtagataagagaaactgtgtttgaggctccatttcatgttcacctaccagtctaccacgtcatttctcaaagacgcaaattttctaattagggatgtgctctttttacatatagatcaatatcctaaaaaaatttaagatattcatattttcgtacatatatatcgagtttcccgaaaaatccataaaaagggtataatgatagtcctttttctcctttaataataatttctgaacaaaattatatcataataaacttgtgattttatacaaaatttatttgtatatataattttactaaacaacgtgaacgataaaaataatattctcataaaatgttgattaaaaattacttaaaataaataattattt

SEQ ID NO: 226 - DNA, 2417 bp, Arabidopsis thaliana
  misc_feature: Encoded by SEQ ID NO: 223
  misc_feature (1)..(2417): Ceres CDNA ID no. 12670159
  misc_feature (1)..(2417): Sequence of endogenous gene to Ceres PROMOTER  YP0040
agcatccacacacactttgaatgctcaatcaaagcttcttcatagttaaacttccacacaacgtcaaaactcgagaagaagatgaaagagagagattcagagagttttgaatctctctcacatcaagttctcccaaacacttcaaattcaacacacatgatccagatggccatggccaactcaggttcatctgcagccgcacaagccggtcaagaccagcctgaccggtcaaagtggctgcttgactgtcctgaaccacctagcccgtggcatgagctcaaaagacaagtcaaaggctctttcctaaccaaagccaaaaagttcaagtcacttcaaaaacagcctttcccaaaacaaatcctctctgtcctccaagccattttcccaatcttcggttggtgcagaaactataaactcaccatgttcaagaacgatctcatggctggtttaaccctcgctagcctctgcattccgcagagcattggttatgcaactcttgcaaagcttgatcctcaatatggcctatatacgagtgtggtaccaccattgatatatgcattgatggggacatcaagagagatagcaatcggaccggtggctgtagtatctcttcttatatcttcaatgttgcagaaactcatcgatccagaaacagatcccttgggatacaagaaactggtcctaaccacaaccttcttcgccgggatcttccaagcttctttcggtttattcaggttagggtttctggtggattttctgtcgcacgcagccatagttgggttcatgggtggtgcagccattgtaattggactccaacagcttaaaggtttgcttggtatcactaacttcaccaccaacactgacattgtctctgttcttcgagctgtctggagatcttgtcaacaacaatggagccctcacactttcatcctcggatgttctttcctcagttttatccttattactcgcttcatcgggaagaagtataagaagctgttttggctaccggcaatagctccgttgatcgccgtggtagtgtcaacactaatggtgtttctgactaaagccgacgagcatggtgtgaagacagtgaggcacatcaaaggaggtcttaatccaatgtccattcaggatctcgactttaatactcctcatctcggacaaatcgctaaaatcggattaatcattgccattgttgctctaaccgaggcgattgcggtggggaggtcgttcgccggaataaaagggtacagactcgatggaaacaaagaaatggtggccattggatttatgaatgttctcggttccttcacatcttgttacgctgctactggttcattctctcggacggccgtgaattttgcggcaggatgtgagacagcaatgtccaacattgttatggcggttacggtgtttgtagcactcgagtgtctaacgaggcttctctactatactccaatcgccatcctcgcttcaataattctctcagcacttccgggactaatcaacattaacgaggctattcacatttggaaagtcgataaattcgattttcttgctctcattggagctttctttggtgttttgttcgcttccgttgagatcggacttcttgtcgcggtggttatttcgtttgccaagatcatactcatatcaattcgtccagggatagaaacgcttggaagaatgcccgggaccgatacttttacagatactaatcaatatcctatgacggttaagactcccggagtgttgatttttcgtgtcaagtctgcattgttgtgctttgccaatgccagttcaattgaggaaaggattatgggatgggtcgatgaggaagaagaagaagaaaacacaaagagcaatgccaagagaaagatcctctttgtagtccttgatatgtcaagtttgatcaacgtcgatacatcggggattactgctttgctggaactgcataacaaattaatcaaaactggtgttgagctagtgatcgttaacccgaaatggcaagtaatccacaagctgaatcaagcaaagttcgtcgacagaatcggtggcaaagtttacttgacgatcggcgaagctcttgatgcttgctttggattaaaagtttaagaaacagttttcaaaggaccagttgtgttacgggttattgcatgtgatgaatttatgtgagttgttgtgatttaaataatgtgatgcgtgcatgatcatgattaatatttaagtacgtatgtgtaatagagtgcttggtcgtgactgaataaagtcatgcaaactataatgtgaggatcgatgggtgtgtttgtaactcgatagatttggaaataatgtataatatatgtaagtttgagaattattggtgttttgtatgattgttgaaatgttatatagaatcagggatatattttttgggg

SEQ ID NO: 227 - protein, 677 aa, Arabidopsis thaliana
  misc_feature (1)..(677): Ceres CDNA ID no. 12670159
  misc_feature (1)..(677): Sequence of endogenous gene to Ceres PROMOTER  YP0040
MKERDSESFESLSHQVLPNTSNSTHMIQMAMANSGSSAAAQAGQDQPDRSKWLLDCPEPPSPWHELKRQVKGSFLTKAKKFKSLQKQPFPKQILSVLQAIFPIFGWCRNYKLTMFKNDLMAGLTLASLCIPQSIGYATLAKLDPQYGLYTSVVPPLIYALMGTSREIAIGPVAVVSLLISSMLQKLIDPETDPLGYKKLVLTTTFFAGIFQASFGLFRLGFLVDFLSHAAIVGFMGGAAIVIGLQQLKGLLGITNFTTNTDIVSVLRAVWRSCQQQWSPHTFILGCSFLSFILITRFIGKKYKKLFWLPAIAPLIAVVVSTLMVFLTKADEHGVKTVRHIKGGLNPMSIQDLDFNTPHLGQIAKIGLIIAIVALTEAIAVGRSFAGIKGYRLDGNKEMVAIGFMNVLGSFTSCYAATGSFSRTAVNFAAGCETAMSNIVMAVTVFVALECLTRLLYYTPIAILASIILSALPGLININEAIHIWKVDKFDFLALIGAFFGVLFASVEIGLLVAVVISFAKIILISIRPGIETLGRMPGTDTFTDTNQYPMTVKTPGVLIFRVKSALLCFANASSIEERIMGWVDEEEEEENTKSNAKRKILFVVLDMSSLINVDTSGITALLELHNKLIKTGVELVIVNPKWQVIHKLNQAKFVDRIGGKVYLTIGEALDACFGLKV

SEQ ID NO: 228 - DNA, 813 bp, Arabidopsis thaliana
  misc_feature (1)..(813): Predicted sequence of Ceres PROMOTER YP0041
atgggtagttcatttaacgctcagatattagttgagaagcttgccaagctcaacaattctcaagcaagcatagagactttatcacattggtgtatctttcacatgaacaaagcaaaacatgttgtagaaacatggggtaggcagtttcactgtgccccacgtgagcaacgtttggcatacttgtacctcgcgaatgatatcttgcagaatagcaggcgaaagggttcggagtttgtaggtgagttctggaaagtactccctgatgctcttcgtgatatgattgaaaatggtgatgactttggaagaaaatccgcacgccgattggttaatatatgggaagaaaggaaagtttttggatcccgtggacaaattctcaaagaagaacttctgggaagacagcctgaaaatggaaccagaaacggaaatctcgtgccacttaagctttctgttcctcagagacaggtaaatggatccacactggagaaagtagtgtctgctgttgaagttcttcacggcgttcagattgatgaggatgctcttgttggaaaatctactaatgctgctggttaccttgagaaagcaacacaagaggttgaaagagatcttagttcaggacacgcccctgggccagcggtggtgaaggagttgcagggacaacatgtcatattgagagactgcatcgaacagctaggggcaatggagacatccagaacaagtcttatctcacatttgagagaagctttacaagaacaggaactcaagctggagcaagtccgtaaccaccttcagacagcttctagaccatggtggtag

SEQ ID NO: 229 - DNA, 546 bp, Arabidopsis thaliana
  misc_feature (1)..(546): Experimental sequence of Ceres PROMOTER  YP0041
gggatgcggttccgcttcctcttgatcttggacgagtcggaggacattgttggatcccagtgcaatggtgcaacatcgaatccaaattctcttaacatcataacacagactaaaatttcaggctttcgtgttaaaagagagaatatcattgaactttttctcttaccttcatgattcctgcaagaacagcacctccgaggtataccatgtgtttccttctcggtggatcttcgatccgcaatctgagtttctgattgataagaaaaacgaagataaatgttaaaagctgagctaatgactgacagtgatcatggcattatcagaattatcttttttaccttcaagccatctttgtttccttttagaactgtgtcgagataccgatcctgtatttctttctcaagactagaaacaaacagagaataaaagacattgaaacataaaacaatggaacttcttgctgggtttatgataaacaaaaaatatacgaaccggctaggtaatcctgggtacatggtgctacctccgcttaaaactatgtgttgg

SEQ ID NO: 230 - DNA, 813 bp, Arabidopsis thaliana; identical to SEQ ID NO: 228
  misc_feature: Encoded by SEQ ID NO: 65
  misc_feature (1)..(813): Ceres CDNA ID no. 12717822
  misc_feature (1)..(813): Sequence of endogenous gene to Ceres PROMOTER  YP0041

SEQ ID NO: 231 - protein, 270 aa, Arabidopsis thaliana
  misc_feature (1)..(270): Ceres CDNA ID no. 12717822
  misc_feature (1)..(270): Sequence of endogenous gene to Ceres PROMOTER  YP0041
MGSSFNAQILVEKLAKLNNSQASIETLSHWCIFHMNKAKHVVETWGRQFHCAPREQRLAYLYLANDILQNSRRKGSEFVGEFWKVLPDALRDMIENGDDFGRKSARRLVNIWEERKVFGSRGQILKEELLGRQPENGTRNGNLVPLKLSVPQRQVNGSTLEKVVSAVEVLHGVQIDEDALVGKSTNAAGYLEKATQEVERDLSSGHAPGPAVVKELQGQHVILRDCIEQLGAMETSRTSLISHLREALQEQELKLEQVRNHLQTASRPWW

SEQ ID NO: 232 - DNA, 999 bp, Arabidopsis thaliana
  misc_feature (1)..(999): Predicted sequence of Ceres PROMOTER  YP0056
ataggaatctgcttcggtagaagattcgagagaggagaggaagcatcggtggttttggagttccttattcttctcttctttccaaagttttgtcattcgccaagattccttaaaaacttgttcacacatcataattatgcaccaataggttataaatcataatccaacaagttagtcattggctttaattttaaaaaatcccataagagtaaaatcttttagaaagttaatcaacccacacatgggctagaaaaccaaaaaccccacgaacattgagattacaagaaacatttttaagtcctaaatgagcccaagagcattgcttaatgaagaagaactgatattaattaactaatattaggacacataaaaaaatacgaaaacaccaatcttcatgccacaaaatcaaacaaaaacgaaaaaatcaattttcatgaaatggataaagagagagcgtaattatcaggaatttgattgagtacggttgttatgatgatcattcacaattatctttgatcttgagatttagcaatagttaattttcggatgtttttttgttacttgctgctcacttcttgtatgcagattaatttataagagagaccagttacaactctttcttatttgaataagattttataagatgtagtgtggccatgtgggtttattgcatgcagctctctgcgttggtcccaagtccacgacaatagagagtttctgcacttcacggtatcgtcgtcgtcacaagttctttaccttatcattggcacaagttagccaccgtctttgcgcaagttagcatgttgtgctacatacgtgtcatgaactgattggtcaaatttggatatattttattcccgtcggttatgtttggataaaaatataaaacggaaatttctgtttcagccttccttggtcccaaagaaaaatacgcacacctactcccttcattctctatcctctccactcataatatatacatctaaatgcaatctctcc

SEQ ID NO: 233 - DNA, 514 bp, Arabidopsis thaliana
  misc_feature (1)..(514): Experimental sequence of Ceres PROMOTER  YP0056
ataggaatctgcttcggtagaagattcgagagaggagaggaagcatcggtggttttggagttccttattcttctcttctttccaaagttttgtcattcgccaagattccttaaaaacttgttcacacatcataattatgcaccaataggttataaatcataatccaacaagttagtcattggctttaattttaaaaaatcccataagagtaaaatcttttagaaagttaatcaacccacacatgggctagaaaaccaaaaaccccacgaacattgagattacaagaaacatttttaagtcctaaatgagcccaagagcattgcttaatgaagaagaactgatattaattaactaatattaggacacataaaaaaatacgaaaacaccaatcttcatgccacaaaatcaaacaaaaacgaaaaaatcaattttcatgaaatggataaagagagagcgtaattatcaggaatttgattgagtacggttgttatgatgatcattcacaattatcttt

SEQ ID NO: 234 - DNA, 488 bp, Arabidopsis thaliana
  misc_feature: Encoded by SEQ ID NO: 231
  misc_feature (1)..(488): Ceres CDNA ID no. 12396394
  misc_feature (1)..(488): Sequence of endogenous gene to Ceres PROMOTER  YP0056
ggtcccaaagaaaaatacgcacacctactcccttcattctctatcctctccactcataatatatacatctaaatgcaatctctccaatttgcacccaatttcttcgaatcaacttatcaatggcctcatcagctgcgatgttcatgctccctcttcctctaactcagcagataacaacaaacaatactctgcagactacagccacaccggaaccgtcagcctccatagttaaatgcctttttccggcgagaaactcatcggaaagttctgctcgttcgaagtttagtctttggctatttggcaatcccgctacgtatgacaagaggttccaagaagctattgaacttagttgcttgtgatggagatttggagatttttcctagtctttttcttgtgttttttaaatggacatattgtaatttcttcccaagtctcaccctccgctgtaatttatctaataatcaattcgatcaaagatgttccgactg

SEQ ID NO: 235 - protein, 79 aa, Arabidopsis thaliana
  misc_feature (1)..(79): Ceres CDNA ID no. 12396394
  misc_feature (1)..(79): Sequence of endogenous gene to Ceres PROMOTER  YP0056
MASSAAMFMLPLPLTQQITTNNTLQTTATPEPSASIVKCLFPARNSSESSARSKFSLWLFGNPATYDKRFQEAIELSCL

SEQ ID NO: 236 - DNA, 998 bp, Arabidopsis thaliana
  misc_feature (1)..(998): Predicted sequence of Ceres PROMOTER  YP0068
aaattggggagtggggagatgtttggttatattcccttctcatcgatggtctagatgtgcgaggtgactctcatggaggtaaagaacaatggtgattttgtgaagaacccaacgtaatggtaattcctaaaaaggttagaagttttttcagcttgttgtattgctaaaatggggttgatgtactcaacgacatccaagtgtacttgagtgagcttttttggggttgagtacctcgacccattattcaaactaatgtaaatggtgaatgcagcagtgactttgttgccttttgcaagaactaaagaagacagaaacaggttgtaaaagagagccaagtgtgtgtttatggtagaaagagcaaagtgaacgaaaggtgtacctttttgacttgttgtcactggttttctcccacttcatccgtttcatgctgcatcagaaaacaacataaggaatgaatgacgtaacgcgaagcattaggagttgcttgtaaattaatacattgccattactaacgtaattcagtagattctaactacaaatgaagtcaatgtatctatttgtctactttagccaatgtatgataagaccaaatagtcttctcttttttcagaaactctctaggattaaaaagtttgtgggtgaaagaaatattatcgtgtggatgataagaataattgatcttgtgttagtaaattaggaatagatatacaagtaggtttctctctaaataaaaaataaaagagtttaaattgcatgcgtataaaagaaaaaagtaagaagaaaatatgttccggttaatggttgggtgcatccgaatcgaaccggcgcaaaccaaaaaatctaaaggagatttgaggtgataaaaggaaatcagacattgaaccaaaaaaacaaaagcgagacggtggaaagaaaaaactggaaaagacagttttagcccctcctaaaagcaaagaaaaaaaagataataaatagcttcgtcgtcgtgatcgacctct

SEQ ID NO: 237 - DNA, 1080 bp, Arabidopsis thaliana
  misc_feature (1)..(1080): Experimental sequence of Ceres PROMOTER  YP0068
aaattggggagtggggagatgtttggttatattcccttctcatcgatggtctagatgtgcgaggtgactctcatggaggtaaagaacaatggtgattttgtgaagaacccaacgtaatggtaattcctaaaaaggttagaagttttttcagcttgttgtattgctaaaatggggttgatgtactcaacgacatccaagtgtacttgagtgagcttttttggggttgagtacctcgacccattattcaaactaatgtaaatggtgaatgcagcagtgactttgttgccttttgcaagaactaaagaagacagaaacaggttgtaaaagagagccaagtgtgtgtttatggtagaaagagcaaagtgaacgaaaggtgtacctttttgacttgttgtcactggttttctcccacttcatccgtttcatgctgcatcagaaaacaacataagaaatgaatgacgtaacgcgaagcattaggagttgcttgtaaattaatacattgccattactaacgtaattcagtagattctaactacaaatgaagtcaatgtatctatctgtctactttagccaatgtatgataagaccaaatagtcttctcttttttcagaaactctctaggattaaaaagtttgtgggtgaaagaaatattatcgtgtggatgataagaataattgatcttgtgttagtaaattaggaatagatatacaagtaggtttctctctaaataaaaaataaaagagtttaaattgcatgcgtataaaagaaaaaagtaagaagaaaatatgttccggttaatggttgggtgcatccgaatcgaaccggcgcaaaccaaaaaatctaaaggagatttgaggtgataaaaggaaatcagacattgaaccaaaaaaacaaaagcgagacggtggaaagaaaaaactggaaaagacagttttagcccctcctaaaagcaaagaaaaaaaagataataaatagcttcgtcgtcgtgatcgacctctgccattgcactgggatccaacaatgtcctccgactcgtccaagatcaagaggaagcggaaccgcatcccgttaaacgaaggc

SEQ ID NO: 238 - DNA, 696 bp, Arabidopsis thaliana
  misc_feature: Encoded by SEQ ID NO: 235
  misc_feature (1)..(696): Ceres CDNA ID no. 12678173
  misc_feature (1)..(696): Sequence of endogenous gene to Ceres PROMOTER  YP0068
gaaatccctaaaataggagggaaaatatattgatcgtagctagggttatcgactcttttgtcaacctctccatggactttttcggttttaacagacctcaggtctgcaaagaacacaaagtgctgaacctgtttgctgataatcctgagatgaaagcctttttcgagaagatattttatagttggtatatcgacgttgaaggattcgacacttcgcttcctgaggatgagatgaaggaggccttgactaatcatttcaagtcatgtggagtaatcgctatggtttctttccggagacaccctgaaaccgatgttgtcaacggccttgctactattaccatgatgggaaatgacgctgatgagaaggtgatgctacttaatggaagtgaattgggaggaaggaaacttgttgtcaaggccaaccctactcccagactgaaacttgaccatcttaaccttccctttggcggctcctctgtcccaggtacatcataagtttggagtctctttggtgttttcagatccagatacaatgcaacctgctttcttttcatcactcgttgggtccttatgaactgtgagacaatgaaaccccctttgggtctttctttctttgccatgtttaaatgtaagctccatatgtatgacgtttgtgtgtggatgattaaagtaagctctattatcattatctagtttg

SEQ ID NO: 239 - protein, 140 aa, Arabidopsis thaliana
  misc_feature (1)..(140): Ceres CDNA ID no. 12678173
  misc_feature (1)..(140): Sequence of endogenous gene to Ceres PROMOTER  YP0068
MDFFGFNRPQVCKEHKVLNLFADNPEMKAFFEKIFYSWYIDVEGFDTSLPEDEMKEALTNHFKSCGVIAMVSFRRHPETDVVNGLATITMMGNDADEKVMLLNGSELGGRKLVVKANPTPRLKLDHLNLPFGGSSVPGTS

SEQ ID NO: 240 - DNA, 999 bp, Arabidopsis thaliana
  misc_feature (1)..(999): Predicted sequence of Ceres PROMOTER  YP0082
tgtccttaagactcttatagtaaagctggaattatatggttcaaggaatcgtctagtctatatacactggtttgaacaattgtgatatataatatagttaggggtatattatatttaatctgttagataacggttggggtacttgaagatctgtaggagttgacagcacgtagaggcagaggtaagaacacttctgcatgtagtgtgtctacataataaaatatagagtgtattttttacacacaccaaaaagagagattataattaatgtattatgtcaaagcatatatgaaggtcagcttagctagagacacgtcttttgtttatctctcgactaaacaacatggcgttttaataaaatcaaaacttaaaaggtccaattcagaacggccccatagtatatagtctacgttgaataaataaacctcaagatagcgtcaaactctttagtctttacccaaaaatatttttttttaaataacgtcaaaactctaagtcttgacctcaacaccaatatatatttgccttctccaatatctgatttttttaattgtttatccgagtcttcttggtcttttcgaatgtttgcccgaaccagaccttcccacgttcggtggttggtggccgcctcggcctttggttgatttctgtccacattttggtccttttcattcatgtaccatgttctagggtcatttgacttgttgaccataaatctactaaaacaggcctaataccgatgggccgtagcccgttaataaacaagacaatttatatttgtttcacttagcttgggagccacggatctctagaaacatccagagaaatatcaatctccccacttctccagaacattcactcactgacaatatcccaccttcaacacttaactcctgtatatagtcctcccctgtctccagtttcgtcgcacacagttctcagataaatactaaactcactgttaaaactttctcaacaaagcttcctgtttctctacaa

SEQ ID NO: 241 - DNA, 111 bp, Arabidopsis thaliana
  misc_feature (1)..(111): Experimental sequence of Ceres PROMOTER  YP0082
aagggatgcggttccgcttcctcttgatcttggacgagtcggaggacattgttggatcccagtgcaatggtttgtagagaaacaggaagctttgttgagaaagttttaaca

SEQ ID NO: 242 - DNA, 830 bp, Arabidopsis thaliana
  misc_feature: Encoded by SEQ ID NO: 239
  misc_feature (1)..(830): Ceres CDNA ID no. 13609100
  misc_feature (1)..(830): Sequence of endogenous gene to Ceres PROMOTER  YP0082
acagttctcagataaatactaaactcactgttaaaactttctcaacaaagcttcctgtttctctacaaatggcatctgctctcgctcttaagagactcctatcatcctccatcgctccacgttcccgtagtgttcttcgtccagctgtttcctctcgcctcttcaacaccaacgccgttaggagctacgacgacgacggcgaaaatggagacggcgttgatttatatcgccgctctgttcctcgccgccgtggtgatttcttctcagatgtgtttgatccgttttcgccgacgaggagcgttagtcaagtgctgaatctgatggaccagttcatggagaatcctctgttatcagctactcgtggcatgggagcttcaggagctcgtcgtggttgggatataaaagagaaagacgatgctctgtacctgagaatcgacatgcctgggctgagcagagaggatgtgaagctggctttggagcaggacactctggtgattagaggagaaggaaaaaacgaggaagatggtggcgaggaaggagagagcggtaatcggagattcacaagcaggattggattaccggataagatttacaagatcgatgagattaaggcggagatgaagaacggagtgttgaaagttgtgatcccgaagatgaaagaacaagagagaaatgatgttcgtcagatcgagatcaactaaaaacgtcgacgtttttttctgttctagttttgttgataggtctttgaataagaagtgtgtgtagtttggcacggtcgatgttgagtcatgtagtctctaaagactaaaaggttatatgtttctttcttg

SEQ ID NO: 243 - protein, 210 aa, Arabidopsis thaliana
  misc_feature (1)..(210): Ceres CDNA ID no. 13609100
  misc_feature (1)..(210): Sequence of endogenous gene to Ceres PROMOTER  YP0082
MASALALKRLLSSSIAPRSRSVLRPAVSSRLFNTNAVRSYDDDGENGDGVDLYRRSVPRRRGDFFSDVFDPFSPTRSVSQVLNLMDQFMENPLLSATRGMGASGARRGWDIKEKDDALYLRIDMPGLSREDVKLALEQDTLVIRGEGKNEEDGGEEGESGNRRFTSRIGLPDKIYKIDEIKAEMKNGVLKVVIPKMKEQERNDVRQIEIN

SEQ ID NO: 244 - DNA, 999 bp, Arabidopsis thaliana
  misc_feature (1)..(999): Predicted sequence of Ceres PROMOTER  YP0019
ttacgcggcgctacactcttatcaaagtttgaagatttttcaagagacacaacagattcaagattttctggtggctaaacttacaatgacagtacatggaggatctccgcgaatggacttctgcaatgtactagcgtagaacaaacactttttgttaaagtcatcaaccaacatagcatagagttgtttatctgaacagaacactgaaagtcttggttttgtttgtgttccagtaaactgtttcaaaatgaaagaaaatacttattaacaagttcggcaaaaaaaattcaaacttttgtgcattattatatgaaagcacttctagaaagctaccttcttcctgctcctcctgttcctagttttcggactctccactcgagtgttccctctcgcttcaatcacaaacggctttactacagacatagctgataaaagggtcgaaaaatcatgaaccaagtaagcgaaacagaggataataaacatggaagaagaacagagtaagacgaattataccactcacttgttattcgaattggaaactggggataaggtttcaaacgagttccgagaatgtcagagactctaaactgaacagtagaaagagaagtcaaagcagccatgccaagtatcattcgtaaagcatcgaaagtcagaacattaccctcagcggaatttaatcaaacaccttctgtgcaggaataatctctgggggttttatcaacactccaaaaaaactggaactttgtaaataaaattataaatgttcgtacctttatgcaaaatttctcacagcgtaattatctatttcctttttgtcctttatgaaagaggataaggtttttaaataataaatactaaattgtttttaaaagaaactaaaaataaatggaaagtcttaagcgtcgtcaatggttctagagtcttctgcaactttcttttcatgaaactactgtaatcttctgctaacatatataatctcaaacactatcttctccaatt

SEQ ID NO: 245 - DNA, 999 bp, Arabidopsis thaliana
  misc_feature (1)..(999): Experimental sequence of Ceres PROMOTER  YP0019
gatataagtagaatcattttttgccgccgtttctcgctaacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggtatgtactttcacaatggctgttttggtttgatgaactctgaattaggcagtgaaaaagtaatcattaccagttaagtgaatttatattgaagattaggatttagctgattgtattggtttgagcatgtgagtttgtgtttaagattgcttgaattgaaatgctttaggttgtttgattacgctaaattctgactaatgtaattcaaattgttgttgtttttttttggtc

SEQ ID NO: 246 - DNA, 815 bp, Arabidopsis thaliana
  misc_feature: Encoded by SEQ ID NO: 243
  misc_feature (1)..(815): Ceres CDNA ID no. 4909291
  misc_feature (1)..(815): Sequence of endogenous gene to Ceres PROMOTER  YP0019
aattgtcttatctttcgacttttcttcttcttcttcttaagagatttttctccaagaaagttcgctccttttctctgttcttaacaaaaaagtctcggtttttttctctttgttttgggtactagcgtgatgtcttctgagaatgatttcgttgagttttcttctatgttcgagagaattatacaaggaagaggtgatggtctctctcgatttttgccggtgattgtagctttagccgccagagaagacgatgatgaccaaggatctaccgatcaaacaacgagacggggagatccgttgagtccaaggttcgtgatgatcggatcgcgatcgggactcgacgatttctttagcgacggtggaaaacaagggaggtcgccggcgttgaagtcagaagtggagaatatgccacgtgtcgtgatcggagaagataaggagaaatatggtggttcttgcgcgatttgtttggatgagtggtctaaaggtgacgtggcggcggagatgccttgtaaacataagtttcactcaaagtgtgtggaggagtggttagggaggcacgccacgtgtcctatgtgtaggtatgagatgcctgttgaagaagttgaagaagagaagaagattgggatttggattggtttctccattaacgccggcgacagaagaaactaagaagacggaggaagaagaagttaaaagtgactcgaaccctcaagatgcaacatggggctaggtttaggtttaggtttgctagaatgttttgtatagtttcgttttcgtttactgaaatcaatttcgaattcaataaaattggttgc

SEQ ID NO: 247 - protein, 179 aa, Arabidopsis thaliana
  misc_feature (1)..(179): Ceres CDNA ID no. 4909291
  misc_feature (1)..(179): Sequence of endogenous gene to Ceres PROMOTER  YP0019
MSSENDFVEFSSMFERIIQGRGDGLSRFLPVIVALAAREDDDDQGSTDQTTRRGDPLSPRFVMIGSRSGLDDFFSDGGKQGRSPALKSEVENMPRVVIGEDKEKYGGSCAICLDEWSKGDVAAEMPCKHKFHSKCVEEWLGRHATCPMCRYEMPVEEVEEEKKIGIWIGFSINAGDRRN

SEQ ID NO: 248 - DNA, 999 bp, Arabidopsis thaliana; identical to SEQ ID NO: 245
  misc_feature (1)..(999): Predicted sequence of Ceres PROMOTER  YP0084

SEQ ID NO: 249 - DNA, 999 bp, Arabidopsis thaliana; identical to SEQ ID NO: 245
  misc_feature (1)..(999): Experimental sequence of Ceres PROMOTER  YP0084

SEQ ID NO: 250 - DNA, 1070 bp, Arabidopsis thaliana
  misc_feature: Encoded by SEQ ID NO: 247
  misc_feature (1)..(1070): Ceres CDNA ID no. 13621692
  misc_feature (1)..(1070): Sequence of endogenous gene to Ceres PROMOTER  YP0084
gggaatgacgttgactttcctttacaaatttcttcttcttcttccttgcccgagtttttctgttgatctaaattctcggaatctggggattttcttttcccggtgtgtctatctcgccgggaaactctaataaaccatcttttcttacttctctatactatcctacgattgcttttcgatttttttttgtcggaattgttgtttgtgtaatattctcgaaagctcggtctcaacaatgggaactccagaatttccagatctgggtaaacactgctccgtcgattattgcaaacagatcgatttcttgcccttcacatgcgatcgctgccttcaggtgtattgtctggatcatcgtagctatatgaaacacgattgtccaaaaggaaacagaggagatgtcactgtggttatttgtccattatgtgctaaaggagttagattaaaccctgacgaagatcccaacatcacctgggagaaacatgttaatacagactgtgatccatctaactacgaaaaagctgtcaagaagaagaaatgtcctgttcctagatgcagagaactcttgacattctccaatactattaaatgtcgagattgtagcatcgatcattgtttgaaacatcggtttggacctgatcatagttgttctggacccaagaagcctgaatcgagtttctcattcatgggtttcttgagtacaaacacaaaagaagctcctgcatcatcatcatcttcttcgagatggtctagtcttttcgcttctgcggaagcaagtattagtagactcggtaacgatataagccagaagttacagtttgcgagtggcaatgatggcaattcagagaaaacgcaagagaggaatggaaaacagaattgtggcaaagttacggttgatgtttgtcccaaatgtagtagagggtttcgtgatccggtggatctattgaagcatatcgataaggatcatcgtggcacttctaaagcctagaagaaaggaagtggttttatatttgtgtgatttgtatcattctttgtaacacagccaggaagaaagaaatttccatattcttttg

SEQ ID NO: 251 - protein, 249 aa, Arabidopsis thaliana
  misc_feature (1)..(249): Ceres CDNA ID no. 13621692
  misc_feature (1)..(249): Sequence of endogenous gene to Ceres PROMOTER  YP0084
MGTPEFPDLGKHCSVDYCKQIDFLPFTCDRCLQVYCLDHRSYMKHDCPKGNRGDVTVVICPLCAKGVRLNPDEDPNITWEKHVNTDCDPSNYEKAVKKKKCPVPRCRELLTFSNTIKCRDCSIDHCLKHRFGPDHSCSGPKKPESSFSFMGFLSTNTKEAPASSSSSSRWSSLFASAEASISRLGNDISQKLQFASGNDGNSEKTQERNGKQNCGKVTVDVCPKCSRGFRDPVDLLKHIDKDHRGTSKA

SEQ ID NO: 252 - DNA, 999 bp, Arabidopsis thaliana
  misc_feature (1)..(999): Predicted sequence of Ceres PROMOTER  YP0087
tgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcatatcacagtttacacattgaaatcataaacgataattatgtattttgtaataaaaagttagttctgaagctcatactttggatagtcgctagtcgctaatatgctccttgtaataattaaagtcactacgacgcacgtcaaagccgatatttagggcttaattgatgcgtgtttttcttttcatataatagtaatataaattagtactaataaagtatgatggatggttgagacagaaaagaaaaaagatgactgtatggtcatcattacaaagaagaatgtattcttcatgttcttaagaataataaaatgtcacttgtaaatcaagttggtaagcattttgagaactttgttcgatgcaacgtatgatgatttatgtagacaaaagataaaaccgtatcttcaactattgccaagaaaagataaaacctaatctagtcagtctctcaacataaatacaacccaatagccaaactgtgtccaattcggagagaaactaaactaaaacaaaacacaaaagcccaacataagcccaataaaacccattttataaacagaacattactaacactca

SEQ ID NO: 253 - DNA, 471 bp, Arabidopsis thaliana
  misc_feature (1)..(471): Experimental sequence of Ceres PROMOTER  YP0087
tgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcaaaaatagataaactcatatcacagtttacacattgaaatcataaac

SEQ ID NO: 254 - DNA, 858 bp, Arabidopsis thaliana
  misc_feature: Encoded by SEQ ID NO: 251
  misc_feature (1)..(858): Ceres CDNA ID no. 13580795
  misc_feature (1)..(858): Sequence of endogenous gene to Ceres PROMOTER  YP0087
tttagggtttattcttcattgcttgagcttccttctcttcttcttcttcaagccgcggctaaagatccctacttctctcgacacttatagagtttcagtcatggccgcctccgcagaaatcgacgctgagattcaacagcagcttaccaatgaggttaagctcttcaaccgttggagctttgatgacgtttcggttacggatattagtcttgtggactacattggtgttcagccatcgaagcacgcaacttttgttccccatactgctggacgatactctgtgaagaggttcagaaaggcgcagtgcccaattgttgagaggctcactaactctctcatgatgcacggaagaaacaatggtaagaagttgatggctgtcaggatcgtcaagcatgccatggagattatccacctcttgtctgacttgaacccgattcaagttatcattgatgccattgttaacagtggtccacgtgaagatgctaccaggattggatctgctggtgtggttaggaggcaggctgttgatatctctcctctaagacgtgtgaaccaagcgatcttcttgcttacaactggtgcacgtgaagctgcctttagaaacatcaagacaatcgctgagtgccttgctgatgaactcatcaatgctgcaaagggatcttccaacagctatgccatcaagaagaaagatgagattgagagagttgctaaggccaatcgttaagggatctccctttcctctaagtttgcattatatcaaagagtttttgtgttgtttccattagctttggatatgtttcagatgatctctctatctttaatgaaattttgacgcttataatcgacttgggatcttga

SEQ ID NO: 255 - protein, 207 aa, Arabidopsis thaliana [sequence omitted]

SEQ ID NO: 256 - DNA, 990 bp, Arabidopsis thaliana
  misc_feature (1)..(990): Predicted sequence of Ceres PROMOTER  YP0180
ttattgttgaaacggatggtatccagattcatagagttatagttgttgacctcgtaaggatgaattcattatcttcttcttcttttgcagcatggaggtgatcgatggtatgactttgatgatagccatgtccaccaaatcagccaagaaaagatcaagacctcggctgcttacgttctgttctataaacgccttgtagactaaagaaactgaagcggaaaagacaagaaagtggtatttgcatttttgccgggtttggcttatttaaaaacatcattggcttgattctaattcactacaagatcaagatgaaagcagctctgcgttgaggctaatttacagaagagagagagagagttgggaagaagagcaaaagaccgagaggacatgttgcggggaatttattttattcttacaaaaattggtatctgattattttattaaccatattcaattagagaatagaagaatagagaaaagcccttttgtgggatatggttctaaattgttgtttagttcttgtgtgtcagttttggctctcgtcgaccaaagaagattaaagaaacctctaccttattttaactcaattcttttgtttttgcaatgtcctttgctttccaaaattgttagtcttacttttcactactttgatagacattgcctttgcgtttccctgattaataagccagagtacttaaatcaaaattgactgttttgtgcatcctgcatcacgtttccaatcagaaccatagtgttgtcgttgtgtcattatccgaatttaagtggagacattggtaagttatttataaactaattacaatctatttttctaattatttcaaataacatatttaagctctgtagcttccactagacggtgaagatttgaagtgagagctctctttgcattgctcacccaccaatggatctacctacccttcttcttcttctcctccttttaaaccctaaaagtttctctttccttcaaca

SEQ ID NO: 257 - DNA, 510 bp, Arabidopsis thaliana
  misc_feature (1)..(510): Experimental sequence of Ceres PROMOTER  YP0180
caatctgatctctagtgccagtcgattggttattgttgaaacggatggtatccagattcatagagttatacgttgttgacctcgtacaggatgaattcattatcttcttcttcttttgcagcatggcaggtgatcgatgggtatgacttgtgatgatagccatgtccaccaaatcagccaagaaaagatcaagacctcggctgcttacgttctgttctataaacgccttgtagactaaagaaactgaagcggaaaagacaagaaagaggtatttgcatttttgccgggtttggcttatttaaaaacatcattggcttgattctaattcactacaagatcaagatgaaagcagctctgcgttgaggctaatttacagaagagagagagagagttgggaagaagagcaaaagaccgagaggacatgttgcggggaatttattttattcttacaaaaattggtatctgattattttattaaccatattcaattagagaatagaagaatagaga

SEQ ID NO: 258 - DNA, 1316 bp, Arabidopsis thaliana
  misc_feature: Encoded by SEQ ID NO: 255
  misc_feature (1)..(1316): Ceres CDNA ID no. 5787483
  misc_feature (1)..(1316): Sequence of endogenous gene to Ceres PROMOTER  YP0180
aacgccacaatcatggctttgttcttatctcctaaaaccatcactcttctcttcttctccctctccctcgcactctactgcagcatcgatcctttccaccactgcgccatttccgatttccccaatttcgtctctcacgaagttatctctccacgtcccgacgaagttccatgggagagagattcacaaaattcacttcagaaatcaaagattctgttttttaaccaaatccaaggtccagagagcgtcgcctttgattctctcggacgtggtccgtacacaggcgttgctgatggtagggttttgttttgggatggagagaaatggattgatttcgcttatacttcgagtaatcgatcggagatttgtgatccgaagccttctgctttgagttacttgaggaatgaacatatatgtggtcgtcctttaggtcttcgtttcgataagagaaccggagatttgtatatagctgatgcttatatgggacttttgaaagttggtcctgaaggtggtttagcaacgccgcttgtaactgaagctgaaggtgtgccgttggggtttactaatgatcttgacattgctgatgatggaactgtttactttacagatagcagcattagttaccagaggaggaacttcttgcagctcgttttctctggagacaatactgggagggttctaaagtatgatccagtagctaagaaagctgttgttttggtctcaaatcttcagtttccgaatggtgtctctatcagcagagacggttctttctttgtattctgcgaaggagatattggaagcctacgaagatactggttgaaaggcgagaaagctggaacgacagatgtgtttgcgtatttaccagggcatcctgataacgtaagaaccaaccaaaagggtgaattttgggtagcgcttcattgcagacgcaactactactcatacttaatggcaagatatcctaagctgaggatgttcatactgagactgccaatcactgcgagaactcactactcgttccagatagggttacggccgcacgggttggtggttaagtatagtcctgaagggaagcttatgcatgttttggaagatagtgaagggaaagttgtgagatcagtaagtgaagtggaagaaaaagatgggaagctttggatgggaagtgtgttgatgaactttgttgctgtctatgacctctgattacttgacctatacgtaaaccacttcactcagtttctagatttagcaaattcccaaaactgttaggtgtgtactgaaaaaatcaaacacttagcacaaacaaactcaatgttatt

SEQ ID NO: 259 - protein, 395 aa, Arabidopsis thaliana
  misc_feature (1)..(395): Ceres CDNA ID no. 5787483
  misc_feature (1)..(395): Sequence of endogenous gene to Ceres PROMOTER  YP0180
MALFLSPKTITLLFFSLSLALYCSIDPFHHCAISDFPNFVSHEVISPRPDEVPWERDSQNSLQKSKILFFNQIQGPESVAFDSLGRGPYTGVADGRVLFWDGEKWIDFAYTSSNRSEICDPKPSALSYLRNEHICGRPLGLRFDKRTGDLYIADAYMGLLKVGPEGGLATPLVTEAEGVPLGFTNDLDIADDGTVYFTDSSISYQRRNFLQLVFSGDNTGRVLKYDPVAKKAVVLVSNLQFPNGVSISRDGSFFVFCEGDIGSLRRYWLKGEKAGTTDVFAYLPGHPDNVRTNQKGEFWVALHCRRNYYSYLMARYPKLRMFILRLPITARTHYSFQIGLRPHGLVVKYSPEGKLMHVLEDSEGKVVRSVSEVEEKDGKLWMGSVLMNFVAVYDL

SEQ ID NO: 260 - DNA, 999 bp, Arabidopsis thaliana
  misc_feature (1)..(999): Predicted sequence of Ceres PROMOTER  YP0186
tggacaattactcttgtgtgtatccttggagttgctgtttcatatgtaagtggacaattactcttgtgtgtagccttggagtttttttatttacgttattttggtcagcctttaattattttgcaaaaaatgtatctgtttttgccacatgcccacataatacatttcgcaaatttgatacattatgctttggcccttgtatattcggtaaaaaaaaaagctcaggctactctcaaaaccggctctgagtattcgtaggccacaatcgaagaaaaaaagtgccgatttacatatttttcatacaaaaaattaaaactgttatgtattattcaaaagctatttacatatgttttactaacacgttttcaatattttcttaatccttttcaaaatttaactaagtataatactttttttgtgtgttatttcgttgttttggttaaagaaaaacgaaaaaaagagagagttattcatccttgcagataaggctagggttggttgaataaagatgtgcatatcttataccactagaccaaagaaacagtcacaagtaaaaggccgaatcctttttataaaatataaacagacgaaagctaatgcttcatgggcttggcccaagtgcaggctctcgctagtcgctacgctacaactatcccatatttaattagtgaagagtattttattattttggtcaacgggctatctttgttgacaaaactatcccattggtaaagaaatagcaaaataggcgtttcattctctatatttaaacttgattttatgaagagttgaatagctgaaccaggaagatatttaagaagcccgtacttcacgctttaactgtcaatcgatagatcataataaatgactatctatggataggaactataactgaattcagaaagaatctactactactataaatactaaaagagtattaatacaacggaaaaaacaaaacaaaaaaaagggggaacaagggagtttcatgttaaaaag

SEQ ID NO: 261 - DNA, 999 bp, Arabidopsis thaliana; identical to SEQ ID NO: 260
  misc_feature (1)..(999): Experimental sequence of Ceres PROMOTER  YP0186

SEQ ID NO: 262 - DNA, 1673 bp, Arabidopsis thaliana
  misc_feature: Encoded by SEQ ID NO: 259
  misc_feature (1)..(1673): Ceres CDNA ID no. 13647840
  misc_feature (1)..(1673): Sequence of endogenous gene to Ceres PROMOTER  YP0186
gaaaaacaaaaaaaagggggaacaagggagtttcatgttaaaaaaaaatgaagctctcttgtttggtttttctcatagtatcgtctcttgtttcgagttctcttgccaccgctccgcccaacacatctatatatgaaagctttctccaatgtttcagcaatcaaacaggtgctcctcctgagaagttatgcgacgtcgttctgcctcaaagcagtgccagcttcactccaaccctacgtgcctacatccgtaacgctcgtttcaacacttccacgtcccccaaacctctgctcgttatcgcggcgcgttctgagtgccacgtccaggccaccgtcctctgcaccaaatctctcaacttccagctcaagactcgcagcggcggccatgactacgacggcgtttcctacatctctaaccgccctttcttcgtcctcgacatgtcctatctccgtaacattaccgtcgatatgtccgacgacggcggctctgcttgggttggagccggcgctactctcggcgaagtttattacaacatttggcagagcagcaaaactcacggcactcacggatttcccgccggtgtttgtcccacagtaggcgctggaggtcacattagcggcgggggctacggcaacatgatcagaaaatacggactttccgtggactacgtcacggacgccaaaatcgtagacgtgaacggacggattctcgatcgtaaatcgatgggagaggatttgttttgggcgattggaggcggtggtggtgcgagcttcggcgtgatcttatctttcaagatcaaactcgtgcctgttcctccgagggtgactgttttcagagtggagaagaccctagtagaaaacgcacttgacatggtccataaatggcagtttgttgctcccaagaccagcccggatctcttcatgaggctaatgttgcagccagtgacccggaacacgactcagacggttcgcgcgtcggtagttgctctgttcttgggaaaacagagcgatctcatgtctctgctgaccaaggagttccccgagcttggtctgaagccggagaattgcacggagatgacgtggatacagtcggtgatgtggtgggccaacaacgacaacgccacggtgattaaaccggagatcctgctggatcgaaatccggattcggcgtctttcttgaaaagaaaatcggattacgtggagaaagagatcagcaaagacggtttagatttcttgtgtaagaagttgatggaggctgggaagctagggctagtgttcaatccatacggagggaaaatgagcgaagttgctacgacggcgactccgttcccacacaggaagaggcttttcaaggtccagcattcgatgaactggaaagacccgggcactgatgttgaaagcagtttcatggaaaagacgagaagcttctacagctacatggctcctttcgtgaccaagaatccaagacacacgtatctcaactacagggatcttgatatcgggatcaacagccatggcccaaacagttacagagaagctgaggtttacgggagaaagtatttcggagagaattttgatcggttggtcaaagtcaaaacagccgtggatccagaaaactttttcagagatgaacaaagtatacctaccttgcctaccaagccatcctcgagttag

SEQ ID NO: 263 - protein, 541 aa, Arabidopsis thaliana
  misc_feature (1)..(541): Ceres CDNA ID no. 13647840
  misc_feature (1)..(541): Sequence of endogenous gene to Ceres PROMOTER  YP0186
MKLSCLVFLIVSSLVSSSLATAPPNTSIYESFLQCFSNQTGAPPEKLCDVVLPQSSASFTPTLRAYIRNARFNTSTSPKPLLVIAARSECHVQATVLCTKSLNFQLKTRSGGHDYDGVSYISNRPFFVLDMSYLRNITVDMSDDGGSAWVGAGATLGEVYYNIWQSSKTHGTHGFPAGVCPTVGAGGHISGGGYGNMIRKYGLSVDYVTDAKIVDVNGRILDRKSMGEDLFWAIGGGGGASFGVILSFKIKLVPVPPRVTVFRVEKTLVENALDMVHKWQFVAPKTSPDLFMRLMLQPVTRNTTQTVRASVVALFLGKQSDLMSLLTKEFPELGLKPENCTEMTWIQSVMWWANNDNATVIKPEILLDRNPDSASFLKRKSDYVEKEISKDGLDFLCKKLMEAGKLGLVFNPYGGKMSEVATTATPFPHRKRLFKVQHSMNWKDPGTDVESSFMEKTRSFYSYMAPFVTKNPRHTYLNYRDLDIGINSHGPNSYREAEVYGRKYFGENFDRLVKVKTAVDPENFFRDEQSIPTLPTKPSSS

SEQ ID NO: 264 - DNA, 996 bp, Arabidopsis thaliana
  misc_feature (1)..(996): Predicted sequence of Ceres PROMOTER  YP0121
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattagcctcatgttctacataaatcctaacaatagcactttgtttct

SEQ ID NO: 265 - DNA, 40 bp, Arabidopsis thaliana
  misc_feature (1)..(40): Experimental sequence of Ceres PROMOTER  YP0121
ttggattttttttttgttgagtcagcagaccatctaatct

SEQ ID NO: 266 - DNA, 1950 bp, Arabidopsis thaliana
  misc_feature: Encoded by SEQ ID NO: 263
  misc_feature (1)..(1950): Ceres CDNA ID no. 12646933
  misc_feature (1)..(1950): Sequence of endogenous gene to Ceres PROMOTER  YP0121
attatattttgttaagtccactcttctctctcatatcttctaaccaaaacagagtcacaaggggctcttaagcccttccaactaaattcttttcttttgttctcttgaaactgaatccaccagacaaaaaaatgggggttgatggtgaactgaaaaagaagaaatgcatcattgctggggttatcacagccttgctcgttctcatggttgtcgctgttggcatcacaacatcaagaaacaccagtcattcagaaaaaatcgtccctgtgcagattaaaacagccaccacggcagttgaagcagtttgtgcacctactgattacaaagagacttgtgtcaatagtctcatgaaagcttctcctgactctactcagcctcttgatctcattaagcttggcttcaacgtcaccattcgatccatagaagatagcatcaagaaagcttccgtggagctgacagccaaggcagctaatgacaaggataccaaaggggctttggagttgtgtgagaagcttatgaatgatgctacagatgatctgaagaagtgtcttgataactttgatgggttctcaattcctcagattgaggactttgtcgaagatcttcgtgtttggcttagtggctccattgcttatcaacaaacatgtatggatacgtttgaagaaactaactcgaaactttcacaagacatgcagaaaatctttaaaacatctagagaactcactagtaatggccttgccatgattactaacatctctaaccttctcggagagttcaacgtcacaggagtaaccggggatctcggtaaatacgcaagaaaacttttgtcggcggaagacggtataccaagttgggttggaccaaacactagacggctcatggcaacgaaaggaggtgtgaaagctaacgtggtggttgcacacgacggaagtggtcagtacaagactatcaatgaagccttgaatgcagtgcctaaagccaaccaaaagccatttgttatctacattaagcaaggtgtctataacgagaaagttgacgtcaccaagaaaatgactcatgtcactttcatcggtgatggaccaaccaaaactaagatcactggtagtctcaactattacattggcaaggtcaagacataccttactgccactgttgcgatcaatggtgataacttcacggcgaagaacatcgggtttgaaaacactgcaggtcccgaaggacatcaagctgtggccctaagagtctcggcggatttggccgtcttctacaactgccaaatcgatggttaccaagacacactctacgtccattctcatcgtcaattcttccgtgactgcacagtctcgggcaccgttgacttcattttcggcgatggtatagtagtcttacaaaactgtaacattgttgtgagaaaacccatgaaaagtcagtcttgcatgatcacagcccaaggccgctccgataaacgtgaatccaccggactcgtgctacaaaactgccatattaccggagaaccagcgtatattcccgtaaaatctataaacaaagcatatcttggaaggccatggaaagagttttcaagaaccattataatgggaacaaccatagacgacgttattgatccagcgggatggcttccttggaatggtgattttgcacttaatacgctttactatgctgagtatgagaataatgggcctgggtcaaaccaagcccaacgtgttaagtggcctggaattaagaaactatcgcccaagcaagctcttcgatttactcctgctaggtttttacgtggtaacttgtggattccaccaaatcgtgtgccttacatggggaattttcagtagattccaattggtgaattttccactttctgtgtgctctttaaaaaaaaaaatgaaggtgaataatttatatgcgtgtcttgtcttaaagtcctgacttgccgaa

SEQ ID NO: 267 - protein, 571 aa, Arabidopsis thaliana
  misc_feature (1)..(571): Ceres CDNA ID no. 12646933
  misc_feature (1)..(571): Sequence of endogenous gene to Ceres PROMOTER  YP0121
MGVDGELKKKKCIIAGVITALLVLMVVAVGITTSRNTSHSEKIVPVQIKTATTAVEAVCAPTDYKETCVNSLMKASPDSTQPLDLIKLGFNVTIRSIEDSIKKASVELTAKAANDKDTKGALELCEKLMNDATDDLKKCLDNFDGFSIPQIEDFVEDLRVWLSGSIAYQQTCMDTFEETNSKLSQDMQKIFKTSRELTSNGLAMITNISNLLGEFNVTGVTGDLGKYARKLLSAEDGIPSWVGPNTRRLMATKGGVKANVVVAHDGSGQYKTINEALNAVPKANQKPFVIYIKQGVYNEKVDVTKKMTHVTFIGDGPTKTKITGSLNYYIGKVKTYLTATVAINGDNFTAKNIGFENTAGPEGHQAVALRVSADLAVFYNCQIDGYQDTLYVHSHRQFFRDCTVSGTVDFIFGDGIVVLQNCNIVVRKPMKSQSCMITAQGRSDKRESTGLVLQNCHITGEPAYIPVKSINKAYLGRPWKEFSRTIIMGTTIDDVIDPAGWLPWNGDFALNTLYYAEYENNGPGSNQAQRVKWPGIKKLSPKQALRFTPARFLRGNLWIPPNRVPYMGNFQ

SEQ ID NO: 268 - DNA, 999 bp, Arabidopsis thaliana
  misc_feature (1)..(999): Predicted sequence of Ceres PROMOTER  YP0096
tgcaaaattgaaaaattgaagggtgagacaaatttaaagataatatctattaaatcctctaattttaaaaatttagcaaaaattgtattttcttatggatcagttagttcacacgtatcttagttagtatcaaatcatatctaatgattagtgataaaactagttagatatctatatgtgtctttaccatttaacttgaatccttcttctttttttacgtaaacaacttgaatccttcgttaatatataaatttaaagcattttttctttaattctattgatcggtatatatttactataagttttagctcatatgcaatttcaaatgatatgcttttaaattttgtctaggtgtgatagttgtatctttaacataaatcttatagcaaaactatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaaaattaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttgtttttttttgagaagttacgttgtgattttgatttcctatataaaagttagattacgtcattttttaa

SEQ ID NO: 269 - DNA, 1020 bp, Arabidopsis thaliana
  misc_feature (1)..(1020): Experimental sequence of Ceres PROMOTER  YP0096
gaggtcagtgagtcgattggtgcaaaattgaaaaattgaagggtgaaacaaatttaaagataatatctattaaatcctctaattttaaaaatttagcaaaaattgtattttcttatggatctgttagttcacacgtatcttaattagtaccaaatcatatctaatgattagtgataaaactagttagatatctatatgtgtctttaccatttaacttgaatccttcttcttttttttacgtaaacaacttgaatccttcgttaatacataaatttaaagcattttttctttaattctattgatcggtatatatttactataagttttagctcatatgcaatttcaaatgatatgcttttaaattttgtctaggtgtgatagttgtatctttaacataaatcttatagcaaaattatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaagtttaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttggttttttttgagaagttacgttgtgattttgatttcctatataaaagttagattacgtcattttttaa

SEQ ID NO: 270 - DNA, 483 bp, Arabidopsis thaliana
  misc_feature: Encoded by SEQ ID NO: 267
  misc_feature (1)..(483): Ceres CDNA ID no. 4949423
  misc_feature (1)..(483): Sequence of endogenous gene to Ceres PROMOTER  YP0096
aacaaatactaatcattctttcttacgatttctttagtaaaataagaatatttcttgtatatttcaaccataagtagatatgtctaaatttaacactcagattactacattgttcattgttttagctttggtgtgtgcgtttgttccggctttctcagtcgaagaagctgaagcaacattattatggaatacttgtcttgttaaaatcactcctaagtgtgctttggatataatcgctgctgtctttgaaaatggaaccatgcctgatccttgttgcaaggatctcgtcaaagaaggaaaagtgtgtcacgatacgcttattaaatatattgcagataaacccatgttaattgcccacgaaacagaatacttgaagaagagtgatgacttgtggaaacattgtgtctcaatttccaaaagtgcttcaaatatggaatgcttttactattttgatttttgagccaaaaaattgatattttctgt

SEQ ID NO: 271 - protein, 126 aa, Arabidopsis thaliana
  misc_feature (1)..(126): Ceres CDNA ID no. 4949423
  misc_feature (1)..(126): Sequence of endogenous gene to Ceres PROMOTER  YP0096
MSKFNTQITTLFIVLALVCAFVPAFSVEEAEATLLWNTCLVKITPKCALDIIAAVFENGTMPDPCCKDLVKEGKVCHDTLIKYIADKPMLIAHETEYLKKSDDLWKHCVSISKSASNMECFYYFDF

SEQ ID NO: 272 - DNA, 999 bp, Arabidopsis thaliana
  misc_feature (1)..(999): Predicted sequence of Ceres PROMOTER  YP0098
tatttttataaattatcttagtaaaagtatgtattttctaatagatctgttagttcatacatatcttaattagtgttaaattagatctaatgattagtgataaagtttttagatatcgatataggtgtctttaccatttaacttgaatcctttgttaatgtaaaattttaaaatattttgctttgattctacttattggtatataattttaacatatcaatccaatgccactcttaaattatcatgtacttttcgatatatgttatgactcacttgttatgaaacgatggattttcaccaattttggttatttattaactagaagttttagctctagtgcaattttaaataatatgcttttaaaattggtctagttataatagttgtatctataacataaaacttataacaaaactatacttgatattcaaaaattattgattttctcttgtgaacttcatattagcctagagaaactttgaaaacctttcaataaattgtatgtcgaataaagttttacaaacatttattagccatttcgattaagactattgtgagcaaaagttttttttattataaaataaataatttgtttaagataaattgtgaattaggcttcttatattttaaaaattatataaatttatactgaaaaattgttagaattttcaaattttaaatttatttggcttaagaacataaatatgtcaatttgaaccttatacccactaaatattccatgttagatatctaaataaaagaaaattaactattgatttcttatattgaattggatattgttacttgtatttatgttttttgtttcatttttaaacgttgataaaatcattaaactaaagttttgtagtatatttatttgtcgaaaatttattcccattaaatataacgttaaatttatttgtctttattaaaaaagttactttgtgattttgatttcctatataaaatttagataacttcaattttcaaataaaaaat

SEQ ID NO: 273 - DNA, 458 bp, Arabidopsis thaliana
  misc_feature (1)..(458): Experimental sequence of Ceres PROMOTER  YP0098
tatttttataaattatcttagtaaaagtatgtattttctaatagatctgttagttcatacatatcttaattagtgttaaattagatctaatgattagtgataaagtttttagatatcgatataggtgtctttaccatttaacttgaatcctttgttaatgtaaaattttaaaatattttgctttgattctacttattggtatataattttaacatatcaatccaatgccactcttaaattatcatgtacttttcgatatatgttatgactcacttgttatgaaacaatggattttcaccaattttggttatttattaactagaagttttagctcttgtgcaattttaaatgatatgcttttaaaattggtctagttataatagttgtatctataacataaaacttataacaaaactatacttgatattcaaaaattattgatttgctcttgtgaactt

SEQ ID NO: 274 - DNA, 711 bp, Arabidopsis thaliana
  misc_feature: Encoded by SEQ ID NO: 271
  misc_feature (1)..(711): Ceres CDNA ID no. 4906343
  misc_feature (1)..(711): Sequence of endogenous gene to Ceres PROMOTER  YP0098
acaaatcatttttcttaggatttgtttagtaaaataaaaatatttcttgtacatttcaatcataagtagatatggctaaatttaactctcagattactacgctattcattgttgtagctttggtgtgtgcatttgttccaactttctcagtcaaagaagctgaagcaaatttattatggaatacttgtcttgttaaattcactcctaagtgtgcgttagatataattgctgctgtcttcgaaaatggaacaatgtctgatccttgttgcaacgatcttgtcaaagaaggaaaagtgtgtcacgatacgcttattaaatatattgcagataaacccatgttaattgctcacgaaacagaatacttgaagaagagtgatgacttgtggaaacattgtgtctcaatctccaaaagtgcttgaaatgtatattgcgtgtactattttcacccaataaattgattgttttctgttgttatagttttcttcacacaagcctttatattttaacttaacaacaattttaaccaaagcgaatttctttcttaaaaagtataactttaatttatgattatctatttgaactcgaaacaaaatttcttataaagagtcgaataataattcaaaatttaactattaagaggagctctaactaatattgtttagtgaaatttaatttttgtattttctttctaattagagtaataagttattc

SEQ ID NO: 275 - protein, 115 aa, Arabidopsis thaliana
  misc_feature (1)..(115): Ceres CDNA ID no. 4906343
  misc_feature (1)..(115): Sequence of endogenous gene to Ceres PROMOTER  YP0098
MAKFNSQITTLFIVVALVCAFVPTFSVKEAEANLLWNTCLVKFTPKCALDIIAAVFENGTMSDPCCNDLVKEGKVCHDTLIKYIADKPMLIAHETEYLKKSDDLWKHCVSISKSA

SEQ ID NO: 276 - DNA, 999 bp, Arabidopsis thaliana
  misc_feature (1)..(999): Predicted sequence of Ceres PROMOTER  YP0108
ttagctgaaccaggaaattgatctcttataccagtttccgggtttagattggtttgatggcgatttgattaaacccccgaaattttatgtcgtagttgtgcatagtattattattctttgcggacaatagacgtatcgggaccaagttctgtagcaaaattgtataagcttaagtttgatgaaatttaaaggtaatcactaaaacccaaatgggacaataaaccggtgaagatttagagtttttaattttgactcatgaatctggagaaagagccctcgttaaaaggagtgaatcaatccataggggaaaaagttttgtctttttaaaaactaaagaaccaaaccttaatagaagcagctcaatgtgtgacaactttccactggcactaagataaagtgactagcgatgagtgcaattattgaaatagtagatggtaaatattacatacaagagtaaaaatatctttatgtcaatgcttaattcagtgtttctggttaacaagagaaacttctctaactttcgtaattgggtcttataaaattttatgcaattatgattttacccttttactacttttcattagctttcacgaatctattttgacaagagaaatcattagaggtaaacatgctttttggtcaagggccttaacagttccaccaatcaagctcaaaagttgtacttaaccgacatcttctgtgaaaacatataattacatgtacaaatcaaaactaccttatgaaataaatagaaatattgcagttcatttctaatttaacctcttcaacttttaaaactatttacatttctttatgtcatttctagtcattttgatgcaaattgtaccatttatggattatcttcacaaatttttaagttggtgaaaactttttggtgggtagttaaaacttgaaatagaaatttactttaccaaaataaactaatgaaaagtaatcactccactccctataataagatttccaacgttcccactaagc

SEQ ID NO: 277 - DNA, 26 bp, Arabidopsis thaliana
  misc_feature (1)..(26): Experimental sequence of Ceres PROMOTER  YP0108
ttagctgaaccaggaaattgatctct

SEQ ID NO: 278 - DNA, 1111 bp, Arabidopsis thaliana
  misc_feature: Encoded by SEQ ID NO: 275
  misc_feature (1)..(1111): Ceres CDNA ID no. 13601936
  misc_feature (1)..(1111): Sequence of endogenous gene to Ceres PROMOTER  YP0108
atcataaacccaccgagacgatgtctctcatcatcgtcttcttcttcttctcactcttgctcacatccaatggacagttcttcgacgagagcaagaactatgaaggctcctccgatctcgttgaccttcaataccacttgggtccggtcatatcctcgccggtgacgagtctctacatcatttggtacggccgatggaacccaactcaccaatctataatccgagactttctctactctgtctctgcaccggcaccggctcagtacccgtcagtatccaactggtggaagacagtgaggctatacagagaccagacaggttccaacatcaccgacactcttgtcttatccggagagttccacgactcaacgtactctcatggatctcatctcactcgcttctctgttcagtctgtgatcagaactgccttgacttccaagttaccactaaacgctgtaaacggcttgtacttagtcttgacctcggatgatgtagagatgcaagagttctgcagagcgatttgcgggtttcattacttcactttcccaagcgttgtgggtgcaaccgtaccgtatgcttgggtgggcaacagtgagagacagtgtccagaaatgtgtgcgtacccatttgcacagcctaagccatttccggggagcgggtttgtagccagagagaagatgaaaccgccaaatggagaggtaggaatcgatgggatgatcagtgtgatagctcatgagctggcagaagtgtcgagtaacccgatgttaaacggatggtatggaggagaggacgcgacagcaccgacagagatagcggatttatgtttgggagtgtatgggtcaggaggaggaggaggctatatgggaagtgtgtataaggataggtggaggaatgtgtataatgtgaagggcgttaaaggaagaaagtatctaattcaatgggtttgggatcttaataggaacagatgctttggaccaaacgctatgaattagagactatcatgtttgttacctcttttcaccaaagccttgagcttgaagcttggggaaacctgtatatggtttatcttttccttgcctagtcgattctatgcatttgattgtttaagact

SEQ ID NO: 279 - protein, 323 aa, Arabidopsis thaliana
  misc_feature (1)..(323): Ceres CDNA ID no. 13601936
  misc_feature (1)..(323): Sequence of endogenous gene to Ceres PROMOTER  YP0108
MSLIIVFFFFSLLLTSNGQFFDESKNYEGSSDLVDLQYHLGPVISSPVTSLYIIWYGRWNPTHQSIIRDFLYSVSAPAPAQYPSVSNWWKTVRLYRDQTGSNITDTLVLSGEFHDSTYSHGSHLTRFSVQSVIRTALTSKLPLNAVNGLYLVLTSDDVEMQEFCRAICGFHYFTFPSVVGATVPYAWVGNSERQCPEMCAYPFAQPKPFPGSGFVAREKMKPPNGEVGIDGMISVIAHELAEVSSNPMLNGWYGGEDATAPTEIADLCLGVYGSGGGGGYMGSVYKDRWRNVYNVKGVKGRKYLIQWVWDLNRNRCFGPNAMN

SEQ ID NO: 280 - DNA, 999 bp, Arabidopsis thaliana
  misc_feature (1)..(999): Predicted sequence of Ceres PROMOTER  YP0134
cctactttaggcttaaacaagaagaaaatatgactgctaagtcatatttttcaactctcatgagcaaccgtaaagttgcaccgcaatatccaacaaatgacattcgtgttatctacaatctaatgttgaaaatttggctcatctaataaaggagacaaaagttatatctctttcacacacacgttaatggaagtgtaaaggcggtgagagtgtgggagagacttggggaacaagaagaaggacgcggtcaaaaagtgacggtgggctacggcttttcttggtagcagttggaaattccattaatgacttaaaaagtgtaaatcttatcttctttttattttgtgatttgatatgcacattcatttcatgaaaatatttgtatagtttgatgatcatacgacaaacttatagggttcacaaagtagatgcaatagttgcatacctctgtttaaatgttcttgttaatattatacttgatgatgaaactcgtgaatgttattcaaaatgtccatgtaatacaagatcatgcactataataagtaatctatcaatttcagcacaacaattttgacaaaaagtaaaaataaaataaaataaactgatatcatatttccgaattatatgtaaacgttttctgtttctcaatggtctctttcactcttgtgttttctaatatttcatttaaacctatttctaaactaagcacatctttgttgattgattgcatttcaaccaaaatcgataaccgaatcattgtttttttatgttttatttcagcttaccacacacgtttagaattttaaaaataaaacaaaaaaaagttaactcgttacaaatgaaaatgatatttttaattggactcgatggaaaggaccaatttattcaacactattgtttagtccgaacacttgccgcgtaagttttccaactccccccattgacctttcgcactttcacaaactccgtatatatataatggatacactctctctttgatct

SEQ ID NO: 281 - DNA, 458 bp, Arabidopsis thaliana
  misc_feature (1)..(458): Experimental sequence of Ceres PROMOTER  YP0134
cctactttaggcttaaacaagaagaaaatatgactgctaagtcatatttttcaactctcatgagcaaccgtaaagttgcaccgcaatatccaacaaatgacattcgtgttatctacaatctaatgttgaaaatttggctcatctaataaaggagacaaaagttatatctctttcacacacacgttaatggaagtgtaaaggcggtgagagtgtgggagagacttggggaacaagaagaaggacgcggtcaaaaagtgacggtgggctacggcttttcttggtagcagttggaaattccattaatgacttaaaaagtgtaaatcttatcttctttttattttgtgatttgatatgcacattcatttcatgaaaatatttgtatagtttgatgatcatacgacaaacttatagggttcacaaagtagatgcaatagttgcatacctctgtttaaatgttc

SEQ ID NO: 282 - DNA, 731 bp, Arabidopsis thaliana
  misc_feature: Encoded by SEQ ID NO: 279
  misc_feature (1)..(731): Ceres CDNA ID no. 13489977
  misc_feature (1)..(731): Sequence of endogenous gene to Ceres PROMOTER  YP0134
cagtcggttctcgagtcatcgccaaggacccacttcatcattttacaaaccaagcaagactaatccaacaaaaaaatagtccacaaaaagatttttacagatggcgattaacagatctttacttttgattcttcttttcatctctgtttctctatcgacggcgaggatcttacccggagagtttgttccagtcatcttctccggagagatccctcctgtttctaagtcggcggtggttggttgcggaggcgagcaggagaccaagacggaatattcttcttttgttcctgaagttgtcgccggaaagttcgggtccttggtgttgaatgctcttccgaaagggagtcgtccggggtctggacccagcaagaaaactaacgacgtcaagacttagcactattctttctagagttttctgtcctaattcttacttctttctttttttgttctttagagattctttgatttttcgttttcaaatagagattattgtaaatgttacatgtattacagaaatttacagtagaagtttaggaaaaatgaggattttatttggtaatgtaagtcgaaatgatcaagacttagactatcatcttgtatcgtttcatcaatatttctttgataaacgttaatcagctttttaatttctatgattatgtatcaattttatttagactaagaaagtcttttaagttaaacgcataaaagagtcaaggataccatttgaattt

SEQ ID NO: 283 - protein, 101 aa, Arabidopsis thaliana
  misc_feature (1)..(101): Ceres CDNA ID no. 13489977
  misc_feature (1)..(101): Sequence of endogenous gene to Ceres PROMOTER  YP0134
MLFRKGVVRGLDPARKLTTSRLSTILSRVFCPNSYFFLFLFFRDSLIFRFQIEIIVNVTCITEIYSRSLGKMRILFGNVSRNDQDLDYHLVSFHQYFFDKR

SEQ ID NO: 284 - DNA, 999 bp, Arabidopsis thaliana
  misc_feature (1)..(999): Predicted sequence of Ceres PROMOTER  YP0111
tatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccatcatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatataaacataaacgccaatcgcagcttttgtacttttggcggtttaca

SEQ ID NO: 285 - DNA, 1068 bp, Arabidopsis thaliana
  misc_feature (1)..(1068): Experimental sequence of Ceres PROMOTER  YP0111
cgattggatttagtctatacattatagggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccaccatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatataaacataaacgccaatcgcagcttttgtacttttggcggtttaca

SEQ ID NO: 286 - DNA, 1130 bp, Arabidopsis thaliana
  misc_feature: Encoded by SEQ ID NO: 283
  misc_feature (1)..(1130): Ceres CDNA ID no. 13619323
  misc_feature (1)..(1130): Sequence of endogenous gene to Ceres PROMOTER  YP0111
acaaaatatcataaacatataaacataaacgccaatcgcagcttttgtacttttggcggtttacaatggagaaaggtttgacgatgtcttgtgttttggtggtggttgcattcttagccatggttcatgtctctgtttcagttccgttcgtagtgtttcctgaaatcggaacacaatgttctgatgctccaaatgctaacttcacacagcttctcagtaacctctctagctcacctggcttttgcatagaaattggcgagggaaatccaataggcgcttcatggttaataccacttacacaacaagcggaagtagcgtgtgataaggtgacgcagatggaagagttgagtcaaggatacaacattgttggaagagctcaggggagcttagtggctcgaggcttaatcgagttctgcgaaggtgggcctcctgttcacaactatatatccttggctggtcctcatgctggcaccgccgatcttcttcggtgtaatacttctggcttaatttgtgacatagcaaatgggataggcaaggaaaatccctacagcgactttgttcaagataatcttgctcctagtggttatttcaaaaaccctaaaaatgtgacagggtacctgaaagactgtcagtatctacctaagcttaacaatgagagaccatacgaaagaaacacaacttacaaagaccgtttcgcaagtttacagaacctggtttttgtcctgtttgagaacgatacggttattgttccaaaagagtcatcttggttcgggttttatccggatggtgacttaacacatgttctccctgttcaagagacaaagctctatatagaagattggataggtctgaaagcattggttgttgctggaaaagtgcagtttgtgaatgtaaccggtgaccacttaataatggcggacgaagatctcgtcaaatacgtcgtacctcttctccaggatcaacagtctgccccaccaagactcaaccgcaagaccaaggagcccttgcatccttaaaatgagcaaatagttcaatcgctatactaattcatccaatgtcgaataagctcagtgatgattgtgtgacacaataatccttcttcttatatgaataataaaagcatactatct

SEQ ID NO: 287 - protein, 316 aa, Arabidopsis thaliana
  misc_feature (1)..(316): Ceres CDNA ID no. 13619323
  misc_feature (1)..(316): Sequence of endogenous gene to Ceres PROMOTER  YP0111
MEKGLTMSCVLVVVAFLAMVHVSVSVPFVVFPEIGTQCSDAPNANFTQLLSNLSSSPGFCIEIGEGNPIGASWLIPLTQQAEVACDKVTQMEELSQGYNIVGRAQGSLVARGLIEFCEGGPPVHNYISLAGPHAGTADLLRCNTSGLICDIANGIGKENPYSDFVQDNLAPSGYFKNPKNVTGYLKDCQYLPKLNNERPYERNTTYKDRFASLQNLVFVLFENDTVIVPKESSWFGFYPDGDLTHVLPVQETKLYIEDWIGLKALVVAGKVQFVNVTGDHLIMADEDLVKYVVPLLQDQQSAPPRLNRKTKEPLHP

SEQ ID NO: 288 - DNA, 999 bp, Arabidopsis thaliana
  misc_feature (1)..(999): Predicted sequence of Ceres PROMOTER  YP0138
tgtgtgtcctaaatagtttctttttaaaatttgtaaataccaagacgcgtatttaagagtattttgaaaagatatttgattataaaaagaaagaaaaagagaaggctgaggattaactgcaacgtctaccgttggaaaagaaaaacgatcagaaaacacagaaattaataaaaagagagaaaaaaaaatagagtatgagagatgcacatgggtgcctgcaaaaaaaaggtagaagaaatttgtctgaaagtgtcacaggcacactctctcgaaccacatttaacaacactccaaacactcttcttctactttgtacccttcagtacattactctttccaaagtccgtgatttacgctcttcgatgacacctctcaacagagagagactacatgtgtacattttcttctaccattaaattttgaagattttcgatgattcaatttagtatatatatggaagataaaattttcattgtctttctacatgatagtaacggttttagaagggtggttatcacttatagtatttgagttaagaaatataaaaatatacgtgactgtttttccttgtaaactatttttaggcccttatttttattcaagtagtcacatacgtgtttgaagtgtatttaactaagaaaaagaaagtaggaaatgaaaaggatatagtatttatggtgtaatcttggtaaggaccaggagatcagaaggggccacaatgtcacaaagaggaccaacaatgaaattaaatcctcagctggcctttaacattttggctcccaccatctccttccacacatatgcacatgtcttcatgtctctctctctctatacgttacctacacaaatatgtacagacaaatagcccattacaaaatctttatttataaatatatactcctcaactccctcaatatccacccatctccttctccataactctctctctctctccctaaacacaaccaaagacttttatctctcaggaaccccaaaaac

SEQ ID NO: 289 - DNA, 999 bp, Arabidopsis thaliana; identical to SEQ ID NO: 288
  misc_feature (1)..(999): Experimental sequence of Ceres PROMOTER  YP0138

SEQ ID NO: 290 - DNA, 693 bp, Arabidopsis thaliana
  misc_feature: Encoded by SEQ ID NO: 287
  misc_feature (1)..(693): Ceres CDNA ID no. 12333534
  misc_feature (1)..(693): Sequence of endogenous gene to Ceres PROMOTER  YP0138
cacccatctccttctccataactctctctctctctccctaaacacaaccaaagacttttatctctcaggaaccccaaaaacaaatggctataatgaagaaaacttcaaaactcactcaaacagcaatgctgaagcagattctgaagagatgctcgagcttagggaagaagaatggaggagggtacgatgaagattgccttccgcttgacgtaccaaagggacacttccctgtctatgtcggagagaacagaagcagatacattgtcccaatctccttcttgacacatcctgagttccaatctctcttacaacgagccgaggaagaatttggattcgatcacgacatgggtctcaccattccttgtgatgaactcgtttttcaaaccctaacatccatgatccgatgatattttatcatttgaagaagaagcagaaggagatggttaaagaagaagcggaaaagcttctcatacaaaaaaagcatctcttctctttttttaagattttttttcctttatttttaagcccatctagggttttttttacgagttaattgactcgtctaactagaaataaatccgtatgagatagagattctatgggtttagatctgtaaataaagtttgtaatgttttcctcacagatcttcgttctgtgagagaagttatttaatgcaagagaaagtattcctcc

SEQ ID NO: 291 - protein, 107 aa, Arabidopsis thaliana
  misc_feature (1)..(107): Ceres CDNA ID no. 12333534
  misc_feature (1)..(107): Sequence of endogenous gene to Ceres PROMOTER  YP0138
MAIMKKTSKLTQTAMLKQILKRCSSLGKKNGGGYDEDCLPLDVPKGHFPVYVGENRSRYIVPISFLTHPEFQSLLQRAEEEFGFDHDMGLTIPCDELVFQTLTSMIR

SEQ ID NO: 292 - DNA, 999 bp, Arabidopsis thaliana
  misc_feature (1)..(999): Predicted sequence of Ceres PROMOTER  YP0177
gaagttcccattttggggcattctaaaactcaactgcatgtgcatatatttgcatattttgactatgaaacttaattgcttctttagtttttttttttcttgtattgtgaaacgttgtaattttttcagagaaatgtaaagtaaatgctgacagctaaagaatgactggggagtaacaaaatagaatgtgtgaatcgtgattgacttttggtggtccgggtttgctagcaaatactactatgacacattcaaatagattcaaatatatatatattttaaaatatagaactatatctatatatatatgtacatatatatataccactaagttttacatggtggtgacttaagtttcaagtttattagttttgggtaagagtctaagagataaattattcatttggtttgaaaagccacactaaaaagatgaaataaccgttttctgagaggggaaacaaaaactctacaacaactttttttttttgggaaactgagagagtggcaaataaaacttctcattaaactcggggccttattaatagccaaaatagttctgaagaacaattaatgatggcaatttatgttttgtttgttcaatgtagagaaggttgtgagggcccgcacgagcaccaacgaacagaacacgtgtgtggacgaccattgggccttgcctttgacaaatccactggtgacctttatatagccgatgcttatatgggccttcttaaagttggcccaacaggtggtgtcgccactcaggtgttaccacgtgagctaaatgaggcccttcgatttaccaattctttggatatcaatccacggaccggagttgtctactttaccgacagtagttcggtttatcaacggaggtacaaaattcttggaaatttaatgaaaaacatgtttttatatgagtgaaaaagatcattgtttatatgttttttttttttgttttgtttatatgatgcattattagtacgtaaattgttttttttttcc

SEQ ID NO: 293 - DNA, 999 bp, Arabidopsis thaliana; identical to SEQ ID NO: 288
  misc_feature (1)..(999): Experimental sequence of Ceres PROMOTER  YP0177

SEQ ID NO: 294 - DNA, 1131 bp, Arabidopsis thaliana
  misc_feature: Encoded by SEQ ID NO: 291
  misc_feature (1)..(1131): Ceres CDNA ID no. 12735519
  misc_feature (1)..(1131): Sequence of endogenous gene to Ceres PROMOTER  YP0177
atgatgaaactcctcttggtggtggcaacttctgttgcccttatctttagcgtcactgatttatccggtgagggaccaaaacatggaggagaatccatgttgacagtccaaatccctgatttccgtctgattcctaccaccggagctttgggaccggagagttttgtctttgattttttcggcgatggtccttacaccggtttatctgacggtcgaattgttaagtggctagctaatgagagccgttggatcgatttcgccgtcaccacctccgcaagagaaggttgtgagggcccgcacgagcaccaacgaacagaacacgtgtgtggacgaccattgggccttgcctttgacaaatccactggtgacctttatatagccgatgcttatatgggccttcttaaagttggcccaacaggtggtgtcgccactcaggtgttaccacgtgagctaaatgaggcccttcgatttaccaattctttggatatcaatccacggaccggagttgtctactttaccgacagtagttcggtttatcaacggaggaactatataggggcgatgatgagtggggacaaaactggtagactgatgaagtacgacaacacgaaacaagtgaccactcttctaagcaacttagcgtttgtaaacggtgtcgctttaagccaaaacggtgattaccttctcgtcgtcgagaccgccatgtgtcgtatcttacgttactggctcaacgaaacgtcggtaaagtctcaatctcacgataactacgagattttcgcggaggggctccctgggtttccagacaacataaagagaagtccacgtggcggattctgggtaggcttgaacacaaaacactcaaagctgacaaagttcgccatgtcgaacgcgtggcttggacgtgccgctttgggcctgccggtggattggatgaaggtccattcggtttgggccaggtacaatgggaacggcatggccgtgaggttgagcgaggatagtggcgttatattagaggtattcgaaggtaaaaatgaaaataagtggatatctataagtgaggttgaagaaaaagatggaactctttgggttggatcggtgaatactcctttcgctggcatgtataaaatctaa

SEQ ID NO: 295 - protein, 376 aa, Arabidopsis thaliana
  misc_feature (1)..(376): Ceres CDNA ID no. 12735519
  misc_feature (1)..(376): Sequence of endogenous gene to Ceres PROMOTER  YP0177
MMKLLLVVATSVALIFSVTDLSGEGPKHGGESMLTVQIPDFRLIPTTGALGPESFVFDFFGDGPYTGLSDGRIVKWLANESRWIDFAVTTSAREGCEGPHEHQRTEHVCGRPLGLAFDKSTGDLYIADAYMGLLKVGPTGGVATQVLPRELNEALRFTNSLDINPRTGVVYFTDSSSVYQRRNYIGAMMSGDKTGRLMKYDNTKQVTTLLSNLAFVNGVALSQNGDYLLVVETAMCRILRYWLNETSVKSQSHDNYEIFAEGLPGFPDNIKRSPRGGFWVGLNTKHSKLTKFAMSNAWLGRAALGLPVDWMKVHSVWARYNGNGMAVRLSEDSGVILEVFEGKNENKWISISEVEEKDGTLWVGSVNTPFAGMYKI

SEQ ID NO: 296 - DNA, 999 bp, Arabidopsis thaliana
  misc_feature (1)..(999): Predicted sequence of Ceres PROMOTER  YP0192
tcctcctactgtctgctacgtcaacaagtggattgcaatcagacggtgattgtgtctcttttcattctctctcttttactaatttctctgataattaaactgagaatgtatattaagaaaaaaaaacaaaaacaagagaggaattttcatacacactaacttaagactctttgtaagttttcccaaatatggattttctagtataaatatgagttcattagtttcaccaagcctacaagcatctctccatctcaaatcatattcacctaaaaatcaggtcccctctctttatatctctaacattcttatatcagatcatattttttggatttcttgttaagtaacaccaatcttttaaaagtgttttcaggttaatataaaagaataatgatgttttcggtgacggttgcgatccttgtttgtcttattggctacatttaccgatcatttaagcctccaccaccgcgaatctgcggccatcctaacggtcctccggttacttctccgagaatcaagctcagtgatggaagatatcttgcttatagagaatctggggttgatagagacaatgctaactacaagatcattgtcgttcatggcttcaacagctccaaagacactgaatttcccatccctaaggttcactcttattctcaatattaactctcgtacatgtcacatgcccattttcaccattttagatatacagttttgatactttactttgcatttattttgctatatgtaattgaggatattgttttaatttctttgggttttttttttggctaaatgagaattcagtgtctttggttcttaaaaaaaaagtatttgttaatggtaaacgctaaacgctatttgagtttatgttttttcaagaactgaaaacgttttattgaaaatatacactttttttgctatttatagaaaggcatatcacatctagacgcaaacgcaaaattgacttttgaagcaaccacaatcttaaatgcaatgaaa

SEQ ID NO: 297 - DNA, 516 bp, Arabidopsis thaliana
  misc_feature (1)..(516): Experimental sequence of Ceres PROMOTER  YP0192
tcctcctactgtctgctacgtcaacaagtggattgcaatcagacggtgattgtgtctcttttcattctctctcttttactaatttctctgataattaaactgagaatgtatattaagaaaaaaaaacaaaaacaagagaggaattttcatacacactaacttaagactctttgtaagttttcccaaatatggattttctagtataaatatgagttcattagtttcaccaagcctacaagcatctctccatctcaaatcatattcacctaaaaatcaggtcccctctctttatatctctaacattcttatatcagatcatattttttggatttcttgttaagtaacaccaatcttttaaaagtgttttcaggttaatataaaagaataatgatgttttcggtgacggttgcgatccttgtttgtcttattggctacatttaccgatcatttaagcctccaccaccgcgaatctgcggccatcctaacggtcctccggttacttctccgagaatcaag

SEQ ID NO: 298 - DNA, 1273 bp, Arabidopsis thaliana
  misc_feature: Encoded by SEQ ID NO: 295
  misc_feature (1)..(1273): Ceres CDNA ID no. 12688453
  misc_feature (1)..(1273): Sequence of endogenous gene to Ceres PROMOTER  YP0192
tcatattcacctaaaaatcaggtcccctctctttatatctctaacattcttatatcagatcatattttttggatttcttgttaagtaacaccaatcttttaaaagtgttttcaggttaatataaaagaataatgatgttttcggtgacggttgcgatccttgtttgtcttattggctacatttaccgatcatttaagcctccaccaccgcgaatctgcggccatcctaacggtcctccggttacttctccgagaatcaagctcagtgatggaagatatcttgcttatagagaatctggggttgatagagacaatgctaactacaagatcattgtcgttcatggcttcaacagctccaaagacactgaatttcccatccctaaggatgtaattgaggagcttgggatatactttgtgttctacgatagagcaggatatggagaaagtgatccacacccatcacgcactgttaagagtgaagcatacgacattcaagaactcgccgataaactcaagatcggaccaaagttctatgttcttggtatatcactaggtgcttactcggtttatagttgcctcaaatacattccccacagactagctggagcagtcttaatggttccatttgtgaactattggtggactaaagtgcctcaagaaaaattgagtaaagcgttggagctaatgccaaagaaagaccaatggacgtttaaagtggctcattatgttccgtggttgttatattggtggttgacccaaaaactatttccgtcttcgagtatggtcacggggaacaatgcgttatgcagcgacaaagatttggtcgtcataaagaagaaaatggagaatccacgccctggcttggaaaaagttagacaacaaggagaccatgaatgtcttcaccgggacatgatagccggattcgcgacatgggaattcgacccgactgaattagaaaatccgtttgcggaaggcgaaggatcggtccacgtttggcaagggatggaagacagaatcattccatacgaaattaatcgatatatatcagagaagcttccatggattaagtaccatgaggtcttaggttatggacatcttctaaacgccgaggaggagaaatgcaaagacattatcaaggcacttcttgtcaactgatgatcatctctacacaagatgccacgaaaaatatagcatatttaatagattttatttatggattataatattatagcatattataagtttgtaagtaagatgaaaaccacttgaaagtc

SEQ ID NO: 299 - protein, 340 aa, Arabidopsis thaliana
  misc_feature (1)..(340): Ceres CDNA ID no. 12688453
  misc_feature (1)..(340): Sequence of endogenous gene to Ceres PROMOTER  YP0192
MMFSVTVAILVCLIGYIYRSFKPPPPRICGHPNGPPVTSPRIKLSDGRYLAYRESGVDRDNANYKIIVVHGFNSSKDTEFPIPKDVIEELGIYFVFYDRAGYGESDPHPSRTVKSEAYDIQELADKLKIGPKFYVLGISLGAYSVYSCLKYIPHRLAGAVLMVPFVNYWWTKVPQEKLSKALELMPKKDQWTFKVAHYVPWLLYWWLTQKLFPSSSMVTGNNALCSDKDLVVIKKKMENPRPGLEKVRQQGDHECLHRDMIAGFATWEFDPTELENPFAEGEGSVHVWQGMEDRIIPYEINRYISEKLPWIKYHEVLGYGHLLNAEEEKCKDIIKALLVN

SEQ ID NO: 300 - DNA, 999 bp, Arabidopsis thaliana
  misc_feature (1)..(999): Predicted sequence of Ceres PROMOTER  YP0204
aactaattaggtcgttaattgtccaagggtttttcatagttgatatagttctgttcaaatatagccatccttaatcgattcatgggatcgtaaattactacttcgagtgttgtaaaaaaaaatgaaacttctacattacaaactcgaatttaatgcatctggagtgatactataaaagtagggatgctctcaggtcgcatttgagagacacagaaatgattttaatggaattaatatattttcagtttttcacaaaaaaaaattgtgtttataacaactgcagattcaatgctgattttatgagtctcacctatagaatttatatttctatattcatagaggcagtataggtgttgacccaacatcgaaagaacacttcgtaaaaaattctttggaacaaggctgaaaatttactcccaaatttagctatccgatgaagataaatcatttaccgtttattaaagaattatcgagattttagtccaaaccaaaagagattatgagcctaagattttgaatttgtattggtaaaagaaattgaacgaaaatttcagaaaaaaatattaataaattgaacgatagagttcacttactacatagtcaactagtgcctagctataatagtttcaaaagacaaaaaaaaacaaaatcggttaactacttccgtgacataattctcattttgatttttgaatccagtctaatttgaaaagtatattcaaaatctttaaatccattaatgataacttttataatacgttgacacacgcaattgtatatacaatattcttgaattttaaatgtaaattctagaatatattgcgatcaccacactaatcaaaatctttgggacaacttgaacccacatttgacttttcttggtcaaatattttggcatcatgcatgatcttctctataaaaaccaaaaggcctcaacgacattcataaactcagtcattatatttatttttgttgtatttcaacgttcaatctctgaaa

SEQ ID NO: 301 - DNA, 262 bp, Arabidopsis thaliana
  misc_feature (1)..(262): Experimental sequence of Ceres PROMOTER  YP0204
aactaattaggtcgttaattgtccaagggtttttcatagttgatatagttctgttcaaatatagccatccttaatcgattcatgggatcgtaaattactacttcgagtgttgtaaaaaaaaatgaaacttctacattacaaactcgaatttaatgcatctggagtgatactataaaagtagggatgctctcaggtcgcatttgagagacacagaaatgattttaatggaattaatatattttcagtttttcacaaaaaaaaa

SEQ ID NO: 302 - DNA, 1735 bp, Arabidopsis thaliana
  misc_feature: Encoded by SEQ ID NO: 299
  misc_feature (1)..(1735): Ceres CDNA ID no. 12669615
  misc_feature (1)..(1735): Sequence of endogenous gene to Ceres PROMOTER  YP0204
aaactcagtcattatatttatttttgttgtatttcaacgttcaatctctgaaaatgaaatatgcattgattcttgttctcttttttgttgtcttcatatggcaatcaagctcatcatcagcaaactcggagactttcacacaatgcctaacctcaaactccgaccccaaacatcccatctcccccgctatcttcttctccggaaatggctcctactcctccgtattacaagccaacatccgtaacctccgcttcaacaccacctcaactccgaaacccttcctcataatcgccgcaacacatgaatcccatgtgcaagccgcgattacttgcgggaaacgccacaaccttcagatgaaaatcagaagtggaggccacgactacgatggcttgtcatacgttacatactctggcaaaccgttcttcgtcctcgacatgtttaacctccgttcggtggatgtcgacgtggcaagtaagaccgcgtgggtccaaaccggtgccatactcggagaagtttattactatatatgggagaagagcaaaaccctagcttatcccgccggaatttgtcccacggttggtgtcggtggccatatcagtggtggaggttacggtaacatgatgagaaaatacggtctcaccgtagataataccatcgatgcaagaatggtcgacgtaaatggaaaaattttggatagaaaattgatgggagaagatctctactgggcaataaacggaggaggaggagggagctacggcgtcgtattggcctacaaaataaaccttgttgaagtcccagaaaacgtcaccgttttcagaatctcccggacgttagaacaaaatgcgacggatatcattcaccggtggcaacaagttgcaccgaagcttcccgacgagcttttcataagaacagtcattgacgtagtaaacggcactgtttcatctcaaaagaccgtcaggacaacattcatagcaatgtttctaggagacacgacaactctactgtcgatattaaaccggagattcccagaattgggtttggtccggtctgactgtaccgaaacaagctggatccaatctgtgctattctggacaaatatccaagttggttcgtcggagacacttctactccaaaggaatcaacccgtgaactacctcaagaggaaatcagattacgtacgtgaaccgatttcaagaaccggtttagagtcaatttggaagaaaatgatcgagcttgaaattccgacaatggctttcaatccatacggtggtgagatggggaggatatcatctacggtgactccgttcccatacagagccggtaatctctggaagattcagtacggtgcgaattggagagatgagactttaaccgaccggtacatggaattgacgaggaagttgtaccaattcatgacaccatttgtttccaagaatccgagacaatcgtttttcaattaccgtgatgttgatttgggtattaattctcataatggtaaaatcagtagttatgtggaaggtaaacgttacgggaagaagtatttcgcaggtaatttcgagagattggtgaagattaagacgagagttgatagtggtaatttctttaggaacgaacagagtattcctgtgttaccataagtgtatttatttgattattggttagtgaaatttgttgttgtataatgattatatgtcgtatttttatttattattagtaatttataaagtttgatatt

SEQ ID NO: 303 - protein, 527 aa, Arabidopsis thaliana
  misc_feature (1)..(527): Ceres CDNA ID no. 12669615
  misc_feature (1)..(527): Sequence of endogenous gene to Ceres PROMOTER  YP0204
MKYALILVLFFVVFIWQSSSSSANSETFTQCLTSNSDPKHPISPAIFFSGNGSYSSVLQANIRNLRFNTTSTPKPFLIIAATHESHVQAAITCGKRHNLQMKIRSGGHDYDGLSYVTYSGKPFFVLDMFNLRSVDVDVASKTAWVQTGAILGEVYYYIWEKSKTLAYPAGICPTVGVGGHISGGGYGNMMRKYGLTVDNTIDARMVDVNGKILDRKLMGEDLYWAINGGGGGSYGVVLAYKINLVEVPENVTVFRISRTLEQNATDIIHRWQQVAPKLPDELFIRTVIDVVNGTVSSQKTVRTTFIAMFLGDTTTLLSILNRRFPELGLVRSDCTETSWIQSVLFWTNIQVGSSETLLLQRNQPVNYLKRKSDYVREPISRTGLESIWKKMIELEIPTMAFNPYGGEMGRISSTVTPFPYRAGNLWKIQYGANWRDETLTDRYMELTRKLYQFMTPFVSKNPRQSFFNYRDVDLGINSHNGKISSYVEGKRYGKKYFAGNFERLVKIKTRVDSGNFFRNEQSIPVLP

SEQ ID NO: 304 - DNA, 1191 bp, Arabidopsis thaliana
  misc_feature (1)..(1191): Predicted sequence of Ceres PROMOTER  pCRS-HT2-pGluB-1
gatctcgatttttgaggaattttagaagttgaacagagtcaatcgaacagacagttgaagagatatggattttctaagatcgggggaccgagtggaccggacgaggatgtggcctaggacgagtgcacaaggctagtggactcggtccccgcgcggtatcccgagtggtccactgtctgcaaacacgattcacatagagcgggcagacgcgggagccgtcctaggtgcaccggaagcaaatccgtcgcctgggtggatttgagtgacacggcccacgtgtagcctcacagctctccgtggtcagatgtgtaaaattatcataatatgtgtttttcaaatagttaaataatatatataggcaagttatatgggtcaataagcagtaaaaaggcttatgacatggtaaaattacttacaccaatatgccttactgtctgatatattttacatgacaacaaagttacaagtacgtcatttaaaaatacaagttacttatcaattgtagtgtatcaagtaaatgacaacaaacctacaaatttgctattttgaaggaacacttaaaaaaatcaataggcaagttatatagtcaataaactgcaagaaggcttatgacatggaaaaattacatacaccaatatgctttattgtccggtatattttacaagacaacaaagttataagtatgtcatttaaaaatacaagttacttatcaattgtcaagtaaatgaaaacaaacctacaaatttgttattttgaaggaacacctaaattatcaaatatagcttgctacgcaaaatgacaacatgcttacaagttattatcatcttaaagttagactcatcttctcaagcataagagctttatggtgcaaaaacaaatataatgacaaggcaaagatacatacatattaagagtatggacagacatttctttaacaaactccatttgtattactccaaaagcaccagaagtttgtcatggctgagtcatgaaatgtatagttcaatcttgcaaagttgcctttccttttgtactgtgttttaacactacaagccatatattgtctgtacgtgcaacaaactatatcaccatgtatcccaagatgcttttttattgctatataaactagcttggtctgtctttgaactcacatcaattagcttaagtttccataagcaagtacaaatagct

SEQ ID NO: 305 - DNA, 999 bp, Arabidopsis thaliana
  misc_feature (1)..(999): Predicted sequence of Ceres PROMOTER  YP0104
tttattttattttttgaatgaaaatgtcttctttattcgtaattttaaactcactggtggtggatatattgttatgtccccaattcgtctggcaactctcgtatattagtgagaaaaatttgtccattatttactgcactattaccctgtgttaattttttgtattgaaattgttttttagtaattcacgtcatatagcgaatgattctttaattttaaaaattcagtcttaagtttacaaattaaataacgctactgtaaccaactctgtacgaccaacatgttcgagtttttgtatatacggccatatatgtacatattttactataaagcgaaaaaatccataaattatttaattaatatataaaggtgccattctatttccaatgtgcttaggaaaatgcagaacctcgtgctatatctctgtcgccacgtgcaaatataacaatatgaaatagaactagcaaatcttgaaatctaactcttaagactaattcaagcacatacgtagagaaagttgaccaacggttatcagcattttaacatggaccttatcaacattttaacaaagtccacaaacaaccagtcttacaatcgcattggtacaagataatcgaattcatcttccatataacaaaacctaaaccttggtgtgaaaaggagaagatatgtatgttaaaggccgcctatgcctctggtttggggtatatgattctaagattagggtttgaatattttcgttagcctgccatgagatatatttatgtgataattagagcctcttatgcattaatgcataaccgactagatcatgtggtattcagctaatcagtacacacaagacaaagtagtaaatgagtttgatgaagactgtggtctgataattcctatcaacgttaaatctgtcggggccaggcagccagcaacattttgcctaacaacgctctgaattcaattgaacctaggctatataatagcaggctaacttaactaagagtt

SEQ ID NO: 306 - DNA, 444 bp, Arabidopsis thaliana
  misc_feature (1)..(444): Experimental sequence of Ceres PROMOTER  YP0104
tttattttattttttgaatgaaaatgtcttctttattcgtaattttaaactcactggtggtggatatattgttatgtccccaattcgtctggcaactctcgtatattagtgagaaaaatttgtccattatttactgcactattaccctgtgttaattttttgtattgaaattgtttttttagtaattcacgtcatatagcgaatgattctttaattttaaaaattcagtcttaagtttacaaattaaataacgctactgtaaccaactctgtacgaccaacatgttcgagtttttgtatatacggccatatatgtacatattttactataaagcgaaaaaatccataaattatttaattaatatataaaggtgccattctatttccaatgtgcttaggaaaatgcagaacctcgtgctatatctctgtcgccacgtgcaaatat

SEQ ID NO: 307 - DNA, 1706 bp, Arabidopsis thaliana
  misc_feature: Encoded by SEQ ID NO: 306
  misc_feature (1)..(1706): Ceres CDNA ID no. 13612879
  misc_feature (1)..(1706): Sequence of endogenous gene to Ceres PROMOTER  YP0104
gtatctatactcataaatccttttgtctaaaaatggcgatgctaggtttttacgtaacgttcattttctttcttgtatgcctatttacttatttcttcctccaaaagaaacctcaaggtcagcctattctcaagaactggccgttcctcaggatgcttccaggaatgctccaccaaatccctcgtatctacgactggaccgtcgaggtgcttgaggcgaccaatctaactttttatttcaaagggccatggcttagtggaacggacatgttgttcaccgccgatccaaggaatattcatcacatactaagctcaaactttgggaattaccctaaaggacctgagttcaagaagatctttgatgttttgggagaaggaatcttaaccgttgattttgagttgtgggaggagatgaggaagtcaaatcacgccctattccacaatcaagatttcatcgagctctcagtaagtagcaataaaagtaagttaaaagaaggtcttgttccttttcttgataatgctgctcagaaaaacattatcatagaattacaagatgtgttccagagattcatgtttgatacttcttcaattttgatgactggttacgatccaatgtcactatccatcgaaatgctggaagttgagttcggtgaagctgcggatattggcgaagaagcaatctattatagacatttcaaaccggtgatcttgtggaggcttcaaaactggattggtattgggcttgagaggaagatgagaacagctttggccactgtcaatcgtatgtttgcgaagatcatatcttcaagaagaaaagaggagataagtcgcgccaaaacggagccatattccaaggacgcgttgacgtattatatgaatgtggacacgagcaaatataagctcttgaaacctaataaagataagtttataagagatgttatttttagtctagtgttagcaggaagggacaccacaagctcagttctcacttggttcttttggcttctttctaagcatcctcaagttatggccaagctcagacatgagatcaacacaaagtttgataatgaagatctagagaagctcgtgtatctgcatgctgcattgtccgaatcaatgagactctacccgccacttcccttcaaccacaagtctcctgcgaagccagatgtacttccaagcgggcacaaagttgatgcaaattcaaagatcgtgatatgtatctatgcattggggaggatgagatctgtatggggagaagacgcattggatttcaaaccagagagatggatttcagacaatggaggtctaagacatgaaccttcatacaagttcatggcttttaattctggtccgagaacttgcttgggtaaaaatctagctctcttgcagatgaagatggtagctctggagatcatacgaaactatgactttaaggtcattgaaggtcacaaggtcgaaccaattccttctatccttctccgtatgaaacatggtcttaaagtcacagtcacaaagaagatatgattattatgcttgcttggcttctacggcaactattactatttccttatttaaatgtgttacttactagtttgttcccacgttataactacttgtattacgtactaagtacggtgtttgtcccacgtcatgctcataaattaattaatatcgtcaataaagtattagagcatcctcgtccat

SEQ ID NO: 308 - protein, 497 aa, Arabidopsis thaliana
  misc_feature (1)..(497): Ceres CDNA ID no. 13612879
  misc_feature (1)..(497): Sequence of endogenous gene to Ceres PROMOTER  YP0104
MAMLGFYVTFIFFLVCLFTYFFLQKKPQGQPILKNWPFLRMLPGMLHQIPRIYDWTVEVLEATNLTFYFKGPWLSGTDMLFTADPRNIHHILSSNFGNYPKGPEFKKIFDVLGEGILTVDFELWEEMRKSNHALFHNQDFIELSVSSNKSKLKEGLVPFLDNAAQKNIIIELQDVFQRFMFDTSSILMTGYDPMSLSIEMLEVEFGEAADIGEEAIYYRHFKPVILWRLQNWIGIGLERKMRTALATVNRMFAKIISSRRKEEISRAKTEPYSKDALTYYMNVDTSKYKLLKPNKDKFIRDVIFSLVLAGRDTTSSVLTWFFWLLSKHPQVMAKLRHEINTKFDNEDLEKLVYLHAALSESMRLYPPLPFNHKSPAKPDVLPSGHKVDANSKIVICIYALGRMRSVWGEDALDFKPERWISDNGGLRHEPSYKFMAFNSGPRTCLGKNLALLQMKMVALEIIRNYDFKVIEGHKVEPIPSILLRMKHGLKVTVTKKI

SEQ ID NO: 309 - DNA, 999 bp, Arabidopsis thaliana
  misc_feature (1)..(999): Predicted sequence of Ceres PROMOTER  YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcactcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttc

SEQ ID NO: 310 - DNA, 1000 bp, Arabidopsis thaliana
  misc_feature (1)..(1000): Experimental sequence of Ceres PROMOTER  YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcaatcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttca

SEQ ID NO: 311 - DNA, 967 bp, Arabidopsis thaliana
  misc_feature: Encoded by SEQ ID NO: 312
  misc_feature (1)..(967): Ceres CDNA ID no. 12679464
  misc_feature (1)..(967): Sequence of endogenous gene to Ceres PROMOTER  YP0008
attcacaccggacattttgaaatctcaacaagaaccaaaccaaacaacaaaaaaacattcttaataattatctttctgttatgtcgatgacggcggattctcaatctgattatgcttttcttgagtccatacgacgacacttactaggaggaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagacccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattat

SEQ ID NO: 312 - protein, 188 aa, Arabidopsis thaliana
  misc_feature (1)..(188): Ceres CDNA ID no. 12679464
  misc_feature (1)..(188): Sequence of endogenous gene to Ceres PROMOTER  YP0008
MLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 313 - DNA, 1002 bp, Arabidopsis thaliana
  misc_feature (1)..(1002): Predicted sequence of Ceres PROMOTER  YP0009
taattcgttttttatactccctctgttccaagatacttgatattttgggtttttgcacaagaattaagaaaagtaacttttatatttttaattattcttttagttagtttaataatattaattttacttctctcatttcattattggttacaaacaaaaataataatgatagtttttcaaaacatcaattttggtggaacaaataaaaaaactcaaaatatcaaataacttgaaacagagggagtagttaattaaaaaaagatatttcacactttgacttggcgaagcctcataacaatgaagttatgtatgaactatatatgaagttagaaacaatggaaaacagcttgtaaatattcattgttgtatatatgtttttttgggtcaatttggtgcatgaacaaaaataaaaacgtagatgaaaaccggatattttggtgttaacatttgcatttgaacttcgtgaaagacggataaaagctcatttttgttctttattatatggctgctattagtacacagagttgaactttagaatactaaaaatctcgacatcttttattttatttttgtcaagcatcgacatcttttctgttcaagaaaacgaccgcaatagtcgaataatataactcttggactagttaatatatatttgcgatagattttcgatctcacttatatcttataaccaagagacaaaaacaatattgcagtcaagtacaaaacgaaaacaatcaatgcaatgtcgactatagatgagtcggtcattcgatccaacggctctgagtccacgaaacacgcaaccaagtggtgctctcttttacaccaaatcatattataaaaaacttaaaagaaagagaggatggttcgttggctccttcttgttccttaattaattcaaattatattcatcacctccattgaataagtccatttcacgacaaagtcaccaatgcttcttttacatgtatatatacttctttccactccctcttctctact

SEQ ID NO: 314 - DNA, 1000 bp, Arabidopsis thaliana
  misc_feature (1)..(1000): Experimental sequence of Ceres PROMOTER  YP0009
aattcgttttttatactccctctgttccaagatacttgatattttgggtttttgcacaagaattaagaaaagtaacttttatatttttaattattcttttagttagtttaataatattaattttacttctctcatttcattattggttacaaacaaaaataataatgatagtttttcaaaacatcaattttggtggaacaaataaaaaaactcaaaatatcaaataacttgaaacagagggagtagttaattaaaaaaagatatttcacactttgacttggcgaagcctcataacaatgaagttatgtatgaactatatatgaagttagaaacaatggaaaacagcttgtaaatattcattgttgtatatatgtttttttgggtcaatttggtgcatgaacaaaaataaaaacgtagatgaaaaccggatattttggtgttaacatttgcatttgaacttcgtgaaagacggataaaagctcatttttgttttttattatatggctgctattagtacacagagttgaactttagaatactaaaaatctcgacatcttttattttatttttgtcaagcatcgacatcttttctgttcaagaaaacgaccgcaatagtcgaataatataactcttggactagttaatatatatttgcgatagattttcgatctcacttatatcttataaccaagagacaaaaacaatattgcagtcaagtacaaaacgaaaacaatcacaatgtcgactatagatgagtcggtcattcgatccaacggctctgagtccacgaaacacgcaaccaagtggtgctctcttttacaccaaatcatattatataaaacttaaaagaaagagaggatggttcgttggctccttcttgttccttaattaattcaaattatattcatcacctccattgaataagtccatttcacgacaaagtcaccaatgcttcttttacatgtatatatacttctttccactccctcttctctactca

SEQ ID NO: 315 - DNA, 1114 bp, Arabidopsis thaliana
  misc_feature: Encoded by SEQ ID NO: 314
  misc_feature (1)..(1114): Ceres CDNA ID no. 12719868
  misc_feature (1)..(1114): Sequence of endogenous gene to Ceres PROMOTER  YP0009
aaatcaaatcttcttccttctctgttttcttaagctttttgaaaattttatcaatggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttctatcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgtacacgtaggtgcatgcgatgaaaaaaacatctatttgttcatatttttgcgtttttctatttgttcattctttttcacaattcacaatacattatttcagttaatgattac

SEQ ID NO: 316 - protein, 300 aa, Arabidopsis thaliana
  misc_feature (1)..(300): Ceres CDNA ID no. 12719868
  misc_feature (1)..(300): Sequence of endogenous gene to Ceres PROMOTER  YP0009
MATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 317 - DNA, 1000 bp, Arabidopsis thaliana
  misc_feature (1)..(1000): Predicted sequence of Ceres PROMOTER  YP0010
aattcgtcttgcattggtaatccaatattccatgtgatgcttttctttctaactgaaggtattcgtgaaaacgaattcaagattgtgggagataattagggtttcgtcaaaagcatgaattaggaaaatttgggattgattttttgaatttgggaaaagtcctaattttaattcgatcaaagcttaaatgatgtcgttttgggctgactaacgaagtcgttaacaggtgccaacgagtgttaaaaatctgttatcgcttgataactctttggttttttagtctaatcaacacattctcatgtttcaaacagttaatcaacatattgttcatgttaaaaaattaacacatgtgaaattgatatataaaaatatcatatattttcaaaagttggatcattaaataaaatttttccctatttttgaaataattctaaaacagtattaaagatatttcctgaaattgtttgcatgtgatcggttttggaccgaaactaaaaaacttagaaactatattaactttgagttgtcgagatgaagatgtgaaatagaaatataggatcaatggttagaattttggcaaatgtatgaaggtgtgtttgattgaatattccaagtcctttgccttttggaattggcataactactacaacaaagttttgataggttttccgaattctttaaactccttaaatttttaatacatctcaatcaaactccacttatactaaaaataatccatattgcatttttaaaaattctaaaagaagaatcacatgataacttgataagcacttttaaatgatagatgtccacgtagaggaataagacaaaaagacaaaataaagaaaaaggacgaaatctaaagagagaaaataagtaacaagtccaagaaaaggtagtatgatctttctcggtccgatcctcgaaactccctcgaaggctcgaaccctctctttgtttttttaccactatataagaaagtccgattcctcgtcactct

SEQ ID NO: 318 - DNA, 1000 bp, Arabidopsis thaliana
  misc_feature (1)..(1000): Experimental sequence of Ceres PROMOTER  YP0010
aattcgtcttgcattggtaatccaatattccatgtgatgcttttctttctaactgaaggtattcgtgaaaacgaattcaagattgtgggagataattagggtttcgtcaaaagcatgaattaggaaaatttgggattgattttttgaatttgggaaaagtcctaattttaattcgatcaaagcttaaatgatgtcgttttgggctgactaacgaagtcgttaacaggtgccaacgagtgttaaaaatctgttatcgcttgataactctttggttttttagtctaatcaacacattctcatgtttcaaacagttaatcaacatattgttcatgttaaaaaattaacacatgtgaaattgatatataaaaatatcatatattttcaaaagttggatcattaaataaaaattttccctatttttgaaataattctaaaacagtattaaagatatttcctgaaattgtttgcatgtgatcggttttggaccgaaactaaaaaacttagaaactatattaactttgagttgtcgagatgaagatgtgaaatagaaatataggatcaatggttagaattttggcaaatgtatgaaggtgtgtttgattgaatattccaagtcctttgccttttggaataggcataactactacaacaaagttttgataggttttccgaattctttaaactccttaaatttttaatacatctcaatcaaactccacttatactaaaaataatccatattgcatttttaaaaatcctaaaagaagaatcacatgataacttgataagcacttttaaatgatagatgtccacgtagaggaataagacaaaaagacaaaataaagaaaaaggacgaaatctaaagagagaaaataagtaacaagtccaagaaaaggtagtatgatctttctcggtccgatcctcgaaactccctcgaaggctcgaaccctctctttgtttttttaccactatataagaaagtccgattcctcgtcactct

SEQ ID NO: 319 - DNA, 1025 bp, Arabidopsis thaliana; identical to SEQ ID NO: 66
  misc_feature: Encoded by SEQ ID NO: 318
  misc_feature (1)..(1025): Ceres CDNA ID no. 12370148
  misc_feature (1)..(1025): Sequence of endogenous gene to Ceres PROMOTER  YP0010

SEQ ID NO: 320 - protein, 241 aa, Arabidopsis thaliana; identical to SEQ ID NO: 67
  misc_feature (1)..(241): Ceres CDNA ID no. 12370148
  misc_feature (1)..(241): Sequence of endogenous gene to Ceres PROMOTER  YP0010

SEQ ID NO: 321 - DNA, 999 bp, Arabidopsis thaliana
  misc_feature (1)..(999): Predicted sequence of Ceres PROMOTER  YP0029
gagactaaatatgaatatgtgtatgtgtatgtgtatgcaggagtagacacgtgcacgtggcacatgcagggaatgggaaggtggagtgttgacaaagaagaagaggatgatccaagtttcgaaatgattccaaaagttatgaactataagccaaagtgctcaatcgccaaacatgaacttaaataaacttcactcgttagatcgttttctcacattaaagccgctctacacttttacccattttaccatttataataaccaccacacatagatattaagttctatggattttattcgtaaacttaagttatgatcaaatagctaaatgattttgcgatttgcccgagttctgtttgtttctaaaatggttatccaaaaagcatatttttgttttatatagaatttgtgatatagaagaaatatactaaaaatgttttaaagtctgtctaaatcataaaccaatgcaaagaaagtgaaataaaccaagatctcgagcaatagacataataaataaacaaacacctaataacatcacatccccactaacaaatgtgaacattaactgttaaaaatcaccaaaaaagtcatcaagatttggctttccttttcaaaagcagtatacgtctctgtctcacacagacagtgtattcaatgcgttgtgttgtcttcccacttttcaccagctgaggttctgcttctttctcttcttctctccaaaacaagaaaattctgcagaataacttttcattcacgagagtggaaggttacagttttccaaatccgagaaacagacacaaaattggtccctctctaaaagttactatcttcgtttaacaaagagatagctcccaatccagtacaaaacagagtactctgctctataaatttcgttcctttattactctgctctataaaacagattattctgctctataagagagatagataaatgagctaaagctcagtaatttctaaacagagagacaagaaaattcaaga

SEQ ID NO: 322 - DNA, 1000 bp, Arabidopsis thaliana
  misc_feature (1)..(1000): Experimental sequence of Ceres PROMOTER  YP0029
gagactaaatatgaatatgtgtatgtgtatgtgtatgcaggagtagacacgtgcacgtggcacatgcagggaatgggaaggtggagtgttgacaaagaagaagaggatgatccaagtttcgaaatgattccaaaagttatgaactataagccaaagtgctcaatcgccaaacatgaacttaaataaacttcactcgttagatcgttttctcacattaaagccgctctacacttttacccattttaccatttataataaccaccacacatagatattaagttctatggattttattcgtaaacttaagttatgatcaaatagctaaatgattttgcgatttgcccgagttctgtttgtttctaaaatggttatccaaaaagcatatttttgttttatatagaatttgtgatatagaagaaatatactaaaaatgttttaaagtctgtctaaatcataaaccaatgcaaagaaagtgaaataaaccaagatctcgagcaatagacataataaataaacaaacacctaataacatcacatccccactaacaaatgtgaacattaactgttaaaaatcaccaaaaaagtcatcaagatttggctttccttttcaaaagcagtatacgtctctgtctcacacagacagtgtattcaatgcgttgtgttgtcttcccacttttcaccagctgaggttctgcttctttctcttcttctctccaaaacaagaaaattctgcagaataacttttcattcacgagagtggaaggttacagttttccaaatccgagaaacagacacaaaattggtccctctctaaaagttactatcttcgtttaacaaagagatagctcccaatccagtacaaaacagagtactctgctctataaatttcgttcctttattactctgctctataaaacagattattctgctctataagagagatagataaatgagctaaagctcagtaatttctaaacagagagacaagaaaattcaagaa

SEQ ID NO: 323 - DNA, 2067 bp, Arabidopsis thaliana
  misc_feature: Encoded by SEQ ID NO: 322
  misc_feature (1)..(2067): Ceres CDNA ID no. 12560350
  misc_feature (1)..(2067): Sequence of endogenous gene to Ceres PROMOTER  YP0029
atggttaccttatgtgccacgttactgatccttctctcaatctttcttgcaactccgtcgaatgttcgaggaaatgcagagctgaaggctttaatggagctgaaatcgtcgcttgaccctgaaaacaagcttctccgttcatggacgtttaacggcgatccatgcgacggatctttcgaaggaattgcatgtaaccagcatctaaaagtcgcaaacatatcattacaagggaaacgtttggtcggaaaattgtctccggcggttgcagagctcaaatgtttgtcaggtctttacttacattacaatagtctctctggagagatacctcaagagatcacaaatcttactgaattatcagatctttatctcaatgttaataacttctctggtgagattccggcagatatcggctccatggctggcttgcaagttatggatctttgttgcaacagtttaacagggaagataccaaagaacattggatccttgaagaaacttaatgtgttgtctctgcaacacaacaaactaaccggagaggttccttggactttaggaaacttgagtatgttaagcaggcttgatttaagcttcaacaatctgttaggtttaatcccaaaaaccctagccaacattcctcagttggacactcttgacttgcgcaacaatactctctctggctttgttcctcctggtcttaagaagttgaatgggagcttccagtttgagaacaacaccgggttatgtggtatcgattttccttctttgagagcttgttctgctttcgataatgcgaataatatcgaacaatttaagcagcctcctggtgaaatagacactgataaatcagctcttcacaacattcccgagtctgtatatctccaaaagcattgcaaccaaacacattgcaagaaatcctcatcgaaactcccacaagttgctttgatttcaagcgtgattaccgtcactataacattgattggtgctggtatattgaccttctttcgctacagaagaaggaagcaaaagatcagtaacacacctgagttttccgagggaagactaagcacagatcaacaaaaagagttccgtgcatcgcctttagtgagtcttgcctacactaaagaatgggatccgctaggtgatagcagaaacggagctgagttttcacaagagcctcatctctttgttgtaaatagtagcttcaggtttaacttagaagacattgaatcagcaacccaatgcttctcagaagctaatctattgagcagaaacagcttcacctcagtgttcaaaggagtcctcagagatggttctccggtagctatcagaagcatcaacataagcagttgcaagaacgaagaagtcgaattcatgaacggtttaaagcttttatcttcgttgtcacacgaaaacttagtgaagctacgtggattctgctgttctagaggcagaggagagtgtttcctcatctatgattttgcttcaaaaggaaagctttcaaattttcttgacttacaagaacgcgaaactaatctggtccttgcttggtctgcaagaatctccatcatcaaagggattgcaaaaggtattgcttacttacatggaagtgatcaacagaagaagcctacaatagttcatcgaaacatctctgtcgaaaaaatcctacttgatgaacaatttaacccgttaatcgctgattcgggtcttcacaaccttctagcagacgatatggtcttctcagcactcaaaacaagtgcagcaatgggatatttagctccggaatacgtcacaaccggaaaattcaccgagaaaaccgatattttcgcctttggagtcatcattctccagatactctctggtaagctcatgcttacaagttcactgagaaatgcagctgaaaatggagaacataacgggttcatcgatgaagatcttcgtgaagagtttgataaaccagaggcgactgcaatggcgaggattgggataagctgtacacaggagataccaaacaataggcctaatatagagacattgcttgagaatataaactgtatgaagagtgaatga

SEQ ID NO: 324 - protein, 688 aa, Arabidopsis thaliana
  misc_feature (1)..(688): Ceres CDNA ID no. 12560350
  misc_feature (1)..(688): Sequence of endogenous gene to Ceres PROMOTER  YP0029
MVTLCATLLILLSIFLATPSNVRGNAELKALMELKSSLDPENKLLRSWTFNGDPCDGSFEGIACNQHLKVANISLQGKRLVGKLSPAVAELKCLSGLYLHYNSLSGEIPQEITNLTELSDLYLNVNNFSGEIPADIGSMAGLQVMDLCCNSLTGKIPKNIGSLKKLNVLSLQHNKLTGEVPWTLGNLSMLSRLDLSFNNLLGLIPKTLANIPQLDTLDLRNNTLSGFVPPGLKKLNGSFQFENNTGLCGIDFPSLRACSAFDNANNIEQFKQPPGEIDTDKSALHNIPESVYLQKHCNQTHCKKSSSKLPQVALISSVITVTITLIGAGILTFFRYRRRKQKISNTPEFSEGRLSTDQQKEFRASPLVSLAYTKEWDPLGDSRNGAEFSQEPHLFVVNSSFRFNLEDIESATQCFSEANLLSRNSFTSVFKGVLRDGSPVAIRSINISSCKNEEVEFMNGLKLLSSLSHENLVKLRGFCCSRGRGECFLIYDFASKGKLSNFLDLQERETNLVLAWSARISIIKGIAKGIAYLHGSDQQKKPTIVHRNISVEKILLDEQFNPLIADSGLHNLLADDMVFSALKTSAAMGYLAPEYVTTGKFTEKTDIFAFGVIILQILSGKLMLTSSLRNAAENGEHNGFIDEDLREEFDKPEATAMARIGISCTQEIPNNRPNIETLLENINCMKSE

SEQ ID NO: 325 - DNA, 999 bp, Arabidopsis thaliana
  misc_feature (1)..(999): Predicted sequence of Ceres PROMOTER  YP0039
ccgttcgagtatttgaaaatttcgggtacacccgcctaaataggcggaccttatctagtatatatatacatttgaactatattgtttactttttagttgatttaggctatgtatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacg

SEQ ID NO: 326 - DNA, 72 bp, Arabidopsis thaliana
  misc_feature (1)..(72): Experimental sequence of Ceres PROMOTER  YP0039
ccgttcgagtatttgaaaatttcgggtacacccgcctaaataggcggaccttatctagtatatatatacatt

SEQ ID NO: 327 - DNA, 1089 bp, Arabidopsis thaliana
  misc_feature: Encoded by SEQ ID NO: 326
  misc_feature (1)..(1089): Ceres CDNA ID no. 13603142
  misc_feature (1)..(1089): Sequence of endogenous gene to Ceres PROMOTER  YP0039
atactcttcgactcagccgtcctttcgcagaaaccatttggagttggagctttggacgacgacaatggccccgaagaaaggagtgaaggtagctgctaagaagaagaccgcggagaaagtttcaaaccctctattcgagaggaggcctaagcaattcggtattggtggagctttacctcctaagaaggatctctctcgctacatcaaatggcccaaatccatccgtcttcaaaggcaaaagaggatcctgaagcagaggttgaaggtccctccagctcttaaccaattcaccaagactcttgacaagaatcttgctaccagcctcttcaaggtccttctgaagtacaggccagaagacaaagctgccaagaaggagcgtcttgtaaagaaggcccaagctgaagctgagggaaagccttctgagtctaagaagcccattgtagtcaaatacggcctcaaccatgtgacctacctcattgagcagaacaaggcccaacttgttgttattgctcatgatgtcgacccaattgagttggttgtctggttgcctgctctgtgcaggaagatggaagtcccgtactgcattgtcaagggcaaatctcgtcttggagcggttgttcaccagaagactgcttcttgcttgtgtttgaccactgtcaagaacgaggacaagctagagttcagcaaaatcctggaagctatcaaggccaacttcaatgacaagtacgaggagtacaggaagaaatggggaggaggcataatgggatctaagtctcaggcaaagaccaaggcaaaggaaagagttattgcaaaggaggctgcccaaaggatgaattaagaggctagcttcttttgtttgtggtttgctcggattcgtaaaacttaatagagctttttgtttagctggttcttgaagtacctcttttttagttgaaccctttattatggatgttttgcaatttcttgggacagtttcaatgttattcaagctgctggatcctctttggtctctcaaccacttaaaacttgacagtgtgaaattttagccaaatgcttattgcattctggaaagagttataagtttaattc

SEQ ID NO: 328 - protein, 257 aa, Arabidopsis thaliana
  misc_feature (1)..(257): Ceres CDNA ID no. 13603142
  misc_feature (1)..(257): Sequence of endogenous gene to Ceres PROMOTER  YP0039
MAPKKGVKVAAKKKTAEKVSNPLFERRPKQFGIGGALPPKKDLSRYIKWPKSIRLQRQKRILKQRLKVPPALNQFTKTLDKNLATSLFKVLLKYRPEDKAAKKERLVKKAQAEAEGKPSESKKPIVVKYGLNHVTYLIEQNKAQLVVIAHDVDPIELVVWLPALCRKMEVPYCIVKGKSRLGAVVHQKTASCLCLTTVKNEDKLEFSKILEAIKANFNDKYEEYRKKWGGGIMGSKSQAKTKAKERVIAKEAAQRMN

SEQ ID NO: 329 - DNA, 999 bp, Arabidopsis thaliana
  misc_feature (1)..(999): Predicted sequence of Ceres PROMOTER  YP0070
cgttaatcgttaagaaaaaaacgtgcctacctagccaaatgacatcttcctcttttgtgtttagcacaagtgaatgatccaaatatcatctacctaatatgacccataaaatagtatgtgattgtctttggatgttatcccataacataacttaaatttgggatgcatgcatatattatatacttcatataaaatgagtggacctcataagttgcggtttcgatttttatcaaaaacaacagttgtccactttttgattttgacacacccacattcaagcatctcctttcttctatattattactcaaagaataacaccccctaaggataacaccattacacaaatcaattctcagttaatcatttgtttcaatatatgttagtacttaagaaatattcgaatagttttacgtattcaaattttataaattcaatgaatgtttaattaccaagtcattttggcttggaatctattcaattattcaaaaaaataaataaaaaatactgcattttaacgtatcagccagtcaatatattacacgtgtcataaagcattacccacacgtttctcctgcctctttccctttcatttttttttttcattttttttgtttcttctcttgttgttgttatcttcttctagctagctctgtgaaacacttcaaatgaacaaatatatcaaataataatagtgtaattaagtcggaggaaaacaacaagaacccagaaagaggaacgaagaaactaattcaaaggtatgatcttttattctttgagagaattatgttttctttgtagcaaatcctctggtcttacgtttagtcactgaatttgttccacttctggaaaaatctagacaccagagcaatctatgaactttaatttccaatcactaccgtcttttgaggttgtaaaatcggtaaatggcagatttttcactctcattcctttgtggtgataggatcaagttcaccgcttcattttagtcattaaacaaag

SEQ ID NO: 330 - DNA, 1007 bp, Arabidopsis thaliana
  misc_feature (1)..(1007): Experimental sequence of Ceres PROMOTER  YP0070
ttggcgttaatcgttaagaaaaaaacgtgcctacctagccaaatgacatcttcctcttttgtgtttagcacaagtgaatgatccaaatatcatctacctaatatgacccataaaatagtatgtgattgtctttggatgttatcccataacataacttaaatttgggatgcatgcatatattatatacttcatataaaatgagtggacctcataagttgcggtttcgatttttatcaaaaacaacagttgtccactttttgattttgacacacacccacattcaagcatctcctttcttctatattattactcaaagaataacaccccctaaggataacaccattacacaaatcaattctcagttaatcatttgtttcaatatatgttagtacttaagaaatattcgaatagttttacgtattcaaattttataaattcagtgaatgtttaattaccaagtcattttggcttggaatctattcaattattcaaaaaaataaataaataatactgcattttaacgtatcagccagtcaatatattacacgtgtcataaagcattacccacacgtttctcctgcctctttccctttcatttttttttttcattttttttgtttcttctcttgttgttgttatcttcttctagctagctctgtgaaacacttcaaatgaacaaatatatcaaataataatagtgtaattaagtcggaggaaaacaacaagaacccagaaagaggaacgaagaaactaattcaaaggtatgatcttttattctttgagagaattatgttttctttgtagcaaatcctctggtcttacgtttagtcactgaatttgttccacttctggaaaaatctagacaccaaaagcaatctatgaactttaatttccaatcactaccgtcttttgaggttgtaaaatcggtaaatggcagatttttcactctcattcctttgtggtgataggatcaagttcaccgcttcattttagtcattaaacaaaga

SEQ ID NO: 331 - DNA, 1405 bp, Arabidopsis thaliana
  misc_feature: Encoded by SEQ ID NO: 330
  misc_feature (1)..(1405): Ceres CDNA ID no. 13612791
  misc_feature (1)..(1405): Sequence of endogenous gene to Ceres PROMOTER  YP0070
aaatgaacaaatatatcaaataataatagtgtaattaagtcggaggaaaacaacaagaacccagaaagaggaacgaagaaactaattcaaaggatcaagttcaccgcttcattttagtcattaaacaaagatggtgatgggaggagaagcatccatggaactggaccagtgttttcagaagatgaagatggaaggaatctcgatcaaagagtggaaagatatccctgtggagcttctgatgaggatcctttcccttgttgatgatcgtaatgtcattgttgcttctggtgtttgcactggctggagagatgctatctcttttggcctcactcgtctccgtctatcttggtgcaacaacaacatgaacagcttggttctttctcttgttcccaagtttgtaaagctgcagactttaaatctaaggcaggacaaaccgcaactagaggacaatgcagtggaggccatagcaaatcactgccatgagttacaagaacttgatctcagcaaaagcttgaaaattacagaccgttcactttatgcacttgctcatggttgcccagacctcacaaaactcaaccttagtggctgcacttcattcagcgacactgctattgcgtatttgaccagattctgcagaaagcttaaagttttgaatctttgcggatgtgtcaaagctgtaactgacaatgccttggaggctattgggaataactgcaatcagatgcagtcactaaacttgggatggtgtgagaatatcagtgatgatggggtaatgagtttagcttatggctgtccagatctcaggacccttgacctctgcggctgtgttcttattacagatgagagtgtggtagctctagcagactggtgtgtccacttgaggtcactggggctatactattgcagaaacataacagacagagcaatgtactcgctagctcaaagcggggtaaagaacaaaccgggatcgtggaaatcggttaagaaaggtaaatacgatgaagaaggactgagaagtctcaacattagccaatgcactgcccttacaccttcagcggttcaagctgtttgcgattcatttcccgcacttcacacatgctcaggaaggcattcgcttgtcatgagcggctgtctgaacttaacaactgtgcactgtgcttgtatccttcaggctcatcgtgcacacaatgcggttcctcatcctgctcattaagacagaggaatagttatgttgtatatataaacatcatgttgatggagattagtattataaacgaagtagcttttttaaggtttatgtgaaaccttagaagcttttgagttgttctttctttgtcttgaaagatcttttgtatattttggtgctatgttcataacttctttagtaagacctctcgttgttacc

SEQ ID NO: 332 - protein, 360 aa, Arabidopsis thaliana
  misc_feature (1)..(360): Ceres CDNA ID no. 13612791
  misc_feature (1)..(360): Sequence of endogenous gene to Ceres PROMOTER  YP0070
MVMGGEASMELDQCFQKMKMEGISIKEWKDIPVELLMRILSLVDDRNVIVASGVCTGWRDAISFGLTRLRLSWCNNNMNSLVLSLVPKFVKLQTLNLRQDKPQLEDNAVEAIANHCHELQELDLSKSLKITDRSLYALAHGCPDLTKLNLSGCTSFSDTAIAYLTRFCRKLKVLNLCGCVKAVTDNALEAIGNNCNQMQSLNLGWCENISDDGVMSLAYGCPDLRTLDLCGCVLITDESVVALADWCVHLRSLGLYYCRNITDRAMYSLAQSGVKNKPGSWKSVKKGKYDEEGLRSLNISQCTALTPSAVQAVCDSFPALHTCSGRHSLVMSGCLNLTTVHCACILQAHRAHNAVPHPAH

SEQ ID NO: 333 - DNA, 999 bp, Arabidopsis thaliana
  misc_feature (1)..(999): Predicted sequence of Ceres PROMOTER  YP0086
cttatcctttaacaatgaacaggtttttagaggtagcttgatgattcctgcacatgtgatcttggcttcaggcttaattttccaggtaaagcattatgagatactcttatatctcttacatacttttgagataatgcacaagaacttcataactatatgctttagtttctgcatttgacactgccaaattcattaatctctaatatctttgttgttgatctttggtagacatgggtactagaaaaagcaaactacaccaaggtaaaatacttttgtacaaacataaactcgttatcacggaacatcaatggagtgtatatctaacggagtgtagaaacatttgattattgcaggaagctatctcaggatattatcggtttatatggaatctcttctacgcagagtatctgttattccccttcctctagctttcaatttcatggtgaggatatgcagttttctttgtatatcattcttcttcttctttgtagcttggagtcaaaatcggttccttcatgtacatacatcaaggatatgtccttctgaatttttatatcttgcaataaaaatgcttgtaccaattgaaacaccagctttttgagttctatgatcactgacttggttctaaccaaaaaaaaaaaaatgtttaatttacatatctaaaagtaggtttagggaaacctaaacagtaaaatatttgtatattattcgaatttcactcatcataaaaacttaaattgcaccataaaattttgttttactattaatgatgtaatttgtgtaacttaagataaaaataatattccgtaagttaaccggctaaaaccacgtataaaccagggaacctgttaaaccggttctttactggataaagaaatgaaagcccatgtagacagctccattagagcccaaaccctaaatttctcatctatataaaaggagtgacattagggtttttgttcgtcctcttaaagcttctcgttttctctgccgtctctc

SEQ ID NO: 334 - DNA, 999 bp, Arabidopsis thaliana; identical to SEQ ID NO: 333
  misc_feature (1)..(999): Experimental sequence of Ceres PROMOTER  YP0086

SEQ ID NO: 335 - DNA, 911 bp, Arabidopsis thaliana
  misc_feature: Encoded by SEQ ID NO: 336
  misc_feature (1)..(911): Ceres CDNA ID no. 12420894
  misc_feature (1)..(911): Sequence of endogenous gene to Ceres PROMOTER  YP0086
ctcttaaagcttctcgttttctctgccgtctctctcattcgcgcgacgcaaacgatcttcagccatggccaccgccgcagatgttgacgctgagattcagcaggcgctcactaacgaagtcaagctcttcaaccgctggacctatgacgacgttacggtcacagacatcagtcttgttgactacattggagttcaggcagctaaacatgctacctttgttccccacaccgctggaagatactctgtgaagagattcaggaaggctcagtgccccattgttgagaggctcaccaactctctcatgatgcacgggaggaacaacggtaagaaattgatggctgtcaggatcgtcaagcacgccatggagattatccacctcttgtctgacttgaacccaattcaggtcatcattgacgccattgtcaacagtggtccacgtgaagatgctaccagaattggatctgctggtgttgttaggagacaagctgttgatatctctcctctaagacgtgttaaccaggctatcttcttgattaccactggtgctcgtgaagctgctttcagaaacatcaagactatagctgagtgccttgctgatgaattgatcaacgcagccaagggctcttccaacagctatgccatcaagaagaaggatgagattgaaagagttgccaaggctaatcgttaaggattttccctttgccctgtgcgttacaatctcgtatcaatgagtttaatgttttatcttcatttagattgaaatatgtatctcagatgtttgctcttttgttttatgaagtttatttcgtctgaactactttgaatagataaatttttgatgctttaagctgtttcgcatcagtttattgtcaatttttgaacttatctaggccacctgaagctagaaattt

SEQ ID NO: 336 - protein, 207 aa, Arabidopsis thaliana [sequence omitted]

SEQ ID NO: 337 - DNA, 999 bp, Arabidopsis thaliana
  misc_feature (1)..(999): Predicted sequence of Ceres PROMOTER  YP0088
gattactacttcatctagtaaggttctgaagacgtttggtgttgataaggaagattcgtctcaggttattactgttgatcttcaaggtttgtgattgtgacgcttgtacatgtgctaatgtatgtctagatttccagtttgctgaaactgtggtgtttatttattgaaaacaaaataaaagtctctcttgatagtttcattgttctaaatagaaaacaagaaacgttttttactttaatcttctacattgataatattggatcaaaggactgtttctgcaagacacaacacaacataaatatacttatactagtttacttatactaacttcattatacatacacacacttgcacttacacctataccttacttctagacatcattaccccgtagaaccaagtttacaagcaagtttaccaacaactctagtctttagcctttaacttggacttactaactagtcattagttgtttaaattttttaatttccatccatatgtttttgttatagattcaaattaaagtcggttgcatttaataaatgtcacttcgttctcttgagataaaatttctctatagtattgtgtttttttgttgtaaaattttcgagtctttttcctaatttgataccatgttttttttctgcacaaattcactcactgttttaacttactatccacttattaatgattttaccattaggcgtcagctagccctgtcaaattggtaaacaagccaagctatctacataattagagatatcattaacgttaatcgtcgtcaattcgaatttgaaagcatagatagctttagcagtacaatgggcaatggtaagaagaatagcaaaaggcccaatatttggtttgcagaaattaaagccttaaaaaagcccacagatatttgtcaaagaatcttaataacctttttgttgctcaagcgccgttcctagggtttttctctgaggaagaagcgtttcatttctctgaatttcatcgaaa

SEQ ID NO: 338 - DNA, 1106 bp, Arabidopsis thaliana
  misc_feature (1)..(1106): Experimental sequence of Ceres PROMOTER  YP0088
tcgattgggattactacttcatctagtaaggttctgaaaacgtttgttgttgataaggaagattcgtctcaggttattactgttgatcttcaaggtttgtgattgtgacgcttatacatgtgctgaaactgtggtgtttatttattgaaaacaaaaaaaaagtctctcttgtagtttcattgtactaaatagaaaacaagaaacgtttttttctttaatcttctacattgataatattggatcaaaggattgtttctgcaagacacaacacaaacatacttatactagtttacttctactaagtactaactacatacccatacacacacttgcacctagactttacttctagacatcattaccctaaggtagaaccaagcttacaagcaagttttaccgacaactcttacattacaactctagtctgtagtctttaacgtagacttactaactagtcattagtggtttaattttttaaattttcatccatatgtttttgttgtagatataaactaaagtcggtcacatttaataattgtcattatgtccgcgtaaaagtcaattcagctattggacatttatgaaatgtaagattttctctctcatttccccgtgcgtgaagacatgcattggtttttctgtaataatcaacaaatccaaaccccttttcgatctttatttggacattgttagagacaaaatttctctatagtctttttcctaatttgataccatgtttttgtttctgcacaaatttactcactggtttaactaactatccacttatttatgattttaccattaggcgtcagctagccctagtcaaatttgtaaacaagccaagctatctacataaatcgagatgtcattaacgttaatcgtcgttaattcgaatttgaaaacatagatagctttagcagtacaatgggcaatggtaagaagaatagcaaaaggcccaatatttggtttgcagaaattaaagccttaaaaaaaagcccacagatatttgtcaaagaaccctaataaccttttcggtgctcaagcgccgtttctagggtttttctctgaggaagaaagcgtttcatttctctgaatttcatcgaaaa

SEQ ID NO: 339 - DNA, 1075 bp, Arabidopsis thaliana
  misc_feature: Encoded by SEQ ID NO: 338
  misc_feature (1)..(1075): Ceres CDNA ID no. 13619634
  misc_feature (1)..(1075): Sequence of endogenous gene to Ceres PROMOTER  YP0088
gggtttttctctgaggaagaagcgtttcatttctctgaatttcatcgaaaatggcggaaagaggaggagaaggcggcgcagagcgtggcggtgaccgtggtgacttcggacgtggattcggcggtggacgtggaggtggccgtggccgtgatcgtggtccaagaggccgtggaagacgtggaggccgtgcctcggaagaaacgaaatgggttccagtgaccaaactaggtcgtctagtggctgacaataaaataacgaagctagagcagatctatctccattctctcccagtaaaggagtaccaaatcatagatcatcttgttggtcctacgttgaaagacgaggttatgaagatcatgcctgttcagaaacaaaccagagctggtcaaaggactagattcaaggcctttgttgttgttggtgatggtaatggtcatgttggtttgggtgtcaagtgttctaaggaagttgctactgccattagaggagctattattcttgctaagctctctgttgttccggtgaggagaggttactgggggaataagattgggaagccacacactgtgccttgtaaggttactgggaagtgtggctctgttactgtgagaatggttcctgctccgagaggttctggtattgttgctgctagggttcctaagaaggttcttcagttcgctggtattgatgatgtctttacttcttccagaggatctactaaaactcttggaaactttgtcaaggcgacgtttgactgcttacagaagacatatgggttccttacaccagagttctggaaagagactagattctccagatcgccctaccaagagcacactgatttcttgtcgactaaggctgtttctgcaaccaaggttatcacggagggtgaagaccaagcttaagaccttcatgagataagttttggttgttcttaatactaattcctactttgaaaaagagtatttttttttcttgattatctatgagttttgttattggtggtttcgttactgttttggattttgttagatgtttgccttaatgcaaatttcaatgaaatagcttttgcaat

SEQ ID NO: 340 - protein, 284 aa, Arabidopsis thaliana
  misc_feature (1)..(284): Ceres CDNA ID no. 13619634
  misc_feature (1)..(284): Sequence of endogenous gene to Ceres PROMOTER  YP0088
MAERGGEGGAERGGDRGDFGRGFGGGRGGGRGRDRGPRGRGRRGGRASEETKWVPVTKLGRLVADNKITKLEQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLSTKAVSATKVITEGEDQA

SEQ ID NO: 341 - DNA, 1000 bp, Arabidopsis thaliana
  misc_feature (1)..(1000): Predicted sequence of Ceres PROMOTER  YP0075
tggattacaaatcattaagctaatatcttcgatgaattaagaagataagtggataacaagtacctaaccgcaatagtccataaattaaaacattaatgtatttgtcgttgaaaatttggccgacttttatttgttattctagtttccacatcaaaaatgtttgtacttcgtagcaatccatccacctaaaccccaaatcttaatttatatttgttgcgtttaaatttgggtgagatttgattctaagtagttgagataaattgatattctattcattagtaaaatgatagagaaattggtttataataattttaccctagaacatgacatgatattggtaaccattaatcaaagaaagagcaaagcatttaatttaccctactctccaaccactccagcctttattagttgcagttgggaatcatttctttatgattcttatgtcattgtctcctaaatcaatgaagtgccttgaccttgttactaattcgaacatagcaaagccaactacatagatcctttacaaagttctaaaaacaggttgtttaggcgtctagacaaacaaaaccattttgtacgattcaacaaattggtccatagaatgttattgatctttcttgtttaggcattcgataaatcggctaatacattatttttttgttttgctttttccttattaaaaatatgcaaagtattatgatgtttaacctgaactgaattttacatttaactggatataggaaaatattgggttgaatttaataattaagcaattgtcacgtaaatcaaattgggcttaatatatattgttgatttcagcaaagacaaagttgggccgtttcaatagtcttcacgcgatgtaagcgttcactaaccaactagagaagacaatcaaatgaatacgttccacgtgacgcttacgaacttgtcagtcactttggtaatatgacagacagtaaccagtaaactactaatctctttcgctaacgaacacacaaaa

SEQ ID NO: 342 - DNA, 1000 bp, Arabidopsis thaliana; identical to SEQ ID NO: 341
  misc_feature (1)..(1000): Experimental sequence of Ceres PROMOTER  YP0075

SEQ ID NO: 343 - DNA, 821 bp, Arabidopsis thaliana
  misc_feature: Encoded by SEQ ID NO: 342
  misc_feature (1)..(821): Ceres CDNA ID no. 13612919
  misc_feature (1)..(821): Sequence of endogenous gene to Ceres PROMOTER  YP0075
aaaaaaagaaccgttttttctttctatggctccaaaactctgagacagagcaagaaaaagataaagtgagtgaaaaaatggcaacggtcacgattctctcacccaaatcgattccaaaggtcactgattccaaattcggagctagggtttctgatcagatcgtcaatgtcgtaaaatgcggcaaatccggccggagattgaagttagcgaagctggtctcagcggctggattgtcacagatcgaaccagacatcaacgaagacccgattggtcaattcgagactaatagcattgaaatggaagatttcaagtatggatattacgatggagctcatacttactatgaaggagaagttcaaaagggaacattttggggagcaattgctgatgacattgctgctgtggatcaaactaatgggtttcaaggtttgatctcttgtatgtttcttcctgctatagctcttgggatgtattttgatgctccgggtgagtacttgttcataggtgcagcgttattcacggtagtgttctgtataatagagatggataaacctgaccagccacacaacttcgagcctcagatatacaaattggagagaggagctcgtgacaagctcattaatgactacaacacaatgagcatttgggactttaatgacaaatatggtgatgtatgggatttcaccattgagaaagatgatatcgccacacgataagataatggattgtgatctcgttataatcatgacttttgatgtaaactgttttataaaattgatgaatgaacggggtacaatgtgtataatattgattgttcattc

SEQ ID NO: 344 - protein, 212 aa, Arabidopsis thaliana
  misc_feature (1)..(212): Ceres CDNA ID no. 13612919
  misc_feature (1)..(212): Sequence of endogenous gene to Ceres PROMOTER  YP0075
MATVTILSPKSIPKVTDSKFGARVSDQIVNVVKCGKSGRRLKLAKLVSAAGLSQIEPDINEDPIGQFETNSIEMEDFKYGYYDGAHTYYEGEVQKGTFWGAIADDIAAVDQTNGFQGLISCMFLPAIALGMYFDAPGEYLFIGAALFTVVFCIIEMDKPDQPHNFEPQIYKLERGARDKLINDYNTMSIWDFNDKYGDVWDFTIEKDDIATR

SEQ ID NO: 345 - DNA, 999 bp, Arabidopsis thaliana
  misc_feature (1)..(999): Predicted sequence of Ceres PROMOTER  YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaataaaagtccaaaatatctaaacactaatctaccacgtctattacacacacacacacacacttgatcttaatttattttcaagattcaagaaaatacccattccattaccacaacttgaccacacgcctatatataaaacataaaagccctttccc

SEQ ID NO: 346 - DNA, 965 bp, Arabidopsis thaliana
  misc_feature (1)..(965): Experimental sequence of Ceres PROMOTER  YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttg

SEQ ID NO: 347 - DNA, 667 bp, Arabidopsis thaliana
  misc_feature: Encoded by SEQ ID NO: 346
  misc_feature (1)..(667): Ceres CDNA ID no. 13616623
  misc_feature (1)..(667): Sequence of endogenous gene to Ceres PROMOTER  YP0101
atttctcattcacttttcatttcaaaagtaaaacaagacaaacaaaaaatacacttaaccatttatttttctctcatgaagaataatactcaacctcaatcatctttcaagaaactttgccggaaactatcaccaaagagggaagattcagccggagagatacaacaacataacagtagcaatggtgaggacaagaacagagagttagaggctgttttttcttacatggatgcaaacagagacggtagaatctcaccagaagagcttcaaaagagtttcatgacattgggagaacaattgtctgatgaagaagccgtagctgctgttagattgtctgatacggacggagatgggatgttggattttgaggaattttctcagttaatcaaagtagatgacgaagaagagaagaagatggagctcaagggagcgtttagactgtatattgcagaaggtgaagattgtattacaccaagaagcttgaagatgatgctaaagaagctaggagaatcaagaaccactgatgattgtagagttatgattagtgcttttgatctcaatgctgatggagttttaagctttgatgagtttgctcttatgatgcgctaagcctccattgttgttgttgttgttgttgttgttgttcttttatttaatctcttattgt

SEQ ID NO: 348 - protein, 177 aa, Arabidopsis thaliana
  misc_feature (1)..(177): Ceres CDNA ID no. 13616623
  misc_feature (1)..(177): Sequence of endogenous gene to Ceres PROMOTER  YP0101
MKNNTQPQSSFKKLCRKLSPKREDSAGEIQQHNSSNGEDKNRELEAVFSYMDANRDGRISPEELQKSFMTLGEQLSDEEAVAAVRLSDTDGDGMLDFEEFSQLIKVDDEEEKKMELKGAFRLYIAEGEDCITPRSLKMMLKKLGESRTTDDCRVMISAFDLNADGVLSFDEFALMMR

SEQ ID NO: 349 - DNA, 999 bp, Arabidopsis thaliana
  misc_feature (1)..(999): Predicted sequence of Ceres PROMOTER  YP0115
tcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttacccat

SEQ ID NO: 350 - DNA, 996 bp, Arabidopsis thaliana
  misc_feature (1)..(996): Experimental sequence of Ceres PROMOTER  YP0115
gtcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttac

SEQ ID NO: 351 - DNA, 1102 bp, Arabidopsis thaliana
  misc_feature: Encoded by SEQ ID NO: 350
  misc_feature (1)..(1102): Ceres CDNA ID no. 12561466
  misc_feature (1)..(1102): Sequence of endogenous gene to Ceres PROMOTER  YP0115
atcattcatcgtacacacacactctctatgacaaagctccccaacatgacgacaacactcaaccatctatttgatctgccggggcagatttgccatgtccagtgtggtttttgcaccactattttgctggtgagtgtaccgtttacaagcttgtcaatggtggtgactgtgagatgtgggcattgcacaagccttctctctgtcaatttgatgaaggcttccttcattcctctccatctccttgcttctctctcccatcttgatgagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaaccacctgagaagcgacaaagagctccttcagcttacaattgcttcatcaaggaagagatcaggaggttaaaggctcagaatccaagcatggctcacaaggaagctttcagcttagctgccaaaaattgggcccattttcctccagctcacaacaagagagctgcttcagatcaatgtttttgtgaggaagataacaatgcgatactaccatgcaatgtttttgaggaccatgaagaaagcaataatgggttccgagagagaaaggctcagaggcattccatttggggaaaatctccatttgagtaataacaatttgggatatgaaaatttaacaaaaaaataaataatggcgtatgacatgtgatggtgactcttttcttctagggtttgattatgttggtttagggtttctgttgttggagagagatagagagaagaagaatctgaaacggaagtaggatttgtgtgtgttcgagaagagtccttgggaatgagcgagtttgttcagtaatttcgtagtacttgtcaactttgaacttaatttgaagagacatgcattgactctataaaaaaaattctacttttgcattcatgactactcttattccatgaatgttttaacattccatgaaacagtactttagtaagaatctttggtaacctatcataataaagatccttcttg

SEQ ID NO: 352 - protein, 240 aa, Arabidopsis thaliana
  misc_feature (1)..(240): Ceres CDNA ID no. 12561466
  misc_feature (1)..(240): Sequence of endogenous gene to Ceres PROMOTER  YP0115
IIHRTHTLSMTKLPNMTTTLNHLFDLPGQICHVQCGFCTTILLVSVPFTSLSMVVTVRCGHCTSLLSVNLMKASFIPLHLLASLSHLDETGKEEVAATDGVEEEAWKVNQEKENSPTTLVSSSDNEDEDVSRVYQVVNKPPEKRQRAPSAYNCFIKEEIRRLKAQNPSMAHKEAFSLAAKNWAHFPPAHNKRAASDQCFCEEDNNAILPCNVFEDHEESNNGFRERKAQRHSIWGKSPFE

SEQ ID NO: 353 - DNA, 1019 bp, Arabidopsis thaliana
  misc_feature (1)..(1019): Predicted sequence of Ceres PROMOTER  YP0133
agtcgattggtattagtccaataactttcacagttttactataatataatattgaaagtatggttaattgacaatagggtatttccactgataatcagtcaccagtaataataatttgttgggactagaatcaatcacttgagttttaaattgatatatgcctagatggttgttaggaccaatattcctaaacaataccaaattttaatatagaaatgtaaaataattcgccgacacattatttcgttattgacattgaatatttcaatgatatcaactctgtttatttacatctatttagtataatttcttgagcaacaaaaaaagtagttttaaagttattttccctagatttttctattgtaaaagcctatatatcacaacaaaaaataaccattttctcttttggcaagtttaaaatttttataatgaatataccatttttaaaaaaaaattatccaaactaaattaaccattttctcttttggcaacaaaaattaaccatttaaaaaaaaaaaaaaaaaaaaagtttaaaatttttataacaacagaaagtaatattatccaaactatgaataattaaaaaatctgtccacatacgatcatatatttctctccaccgacagccgaaaacactgtcaatggcccacgttcctctaaaagctgtcgtcttcggtaatattttccggtaataaactaacttccgatcacaattacacaaaagcccctttctcgtttataatcataggctatgattcatagcaaacttacagagttggttattaagaagtcaaaaatacagattccttaaaatattttttttctgttcatatattttttatcgagaaacaattacttaaacataagaagcaagacaagaattaatgttcttattaacatgatgctaatataatcggaaaacaaaatcaaatcatgatagaagggtaaaatggtcaaatcatcgttcccggctcaaattttactaaaacagccactagccagccagatcccattgcact

SEQ ID NO: 354 - DNA, 1009 bp, Arabidopsis thaliana
  misc_feature (1)..(1009): Experimental sequence of Ceres PROMOTER  YP0133
gtcgattggtattagtccaataactttcacagttttactataatataatattgaaagtatggttaattgacaatagggtatttccactgataatcagtcaccagtaataataatttgttgggactagaatcaatcacttgagttttaaattgatatatgcctagatggttgttaggaccaatattcctaaacaataccaaattttaatatagaaatgtaaaataattcgccgacacattatttcgttattgacattgaatatttcaatgatatcaactctgtttatttacatctatttagtataatttcttgagcaacaaaaaaagtagttttaaagttattttccctagatttttctattgtaaaagcctatatatcacaacaaaaattaaccattttctcttttggcaagtttaaaatttttataatgaatataccattttaaaaaaaaaattatccaaactaaattaaccattttctcttttggcaacaaaaattaaccatttaaaaaaaaaaaaaaaaaaaaagtttaaaatttttataacaacagaaagtaatattatccaaactatgaataattaaaaaatctgtccacatacgatcatatatttctctccaccgacagccgaaaacactgtcaatggcccacgttcctctaaaagctgtcgtcttcggtaatattttccggtaataaactaacttccgatcacaattacacaaaagcccctttctcgtttataatcataggctatgattcatagcaaacttacagagttggttattaagaagtcaaaaatacagattccttaaaatattttttttctgttcatatattttttatcgagaaacaattacttaaacataagaagcaagacaagaattaatgttcttattaacatgatgctaatataatcggaaaacaaaatcaaatcatgatagaagggtaaaatggtcaaatcatcgttcccggctcaaattttactaaaacagccactagccagccagatcc

SEQ ID NO: 355 - DNA, 1765 bp, Arabidopsis thaliana
  misc_feature: Encoded by SEQ ID NO: 354
  misc_feature (1)..(1765): Ceres CDNA ID no. 13601536
  misc_feature (1)..(1765): Sequence of endogenous gene to Ceres PROMOTER  YP0133
aaaaatgtctcattgcttctctcgttctaaaaaaaatcttgctgctatctctctataagtccactcctccttcaagcaaagcaccttcctcttctttttgctcctctgagattggtttaagattaaaccagacccatctaagggatctggaacaagcttcgtctctggttccactctgatcatcagagtattaaaaatggagtctttcttctccagatccacctccatcgtctccaaattgagtttcttggccttatggatcgtcttcttgatttcttcatcttcttttacttcgacagaagcatatgatgcgcttgatccagaaggcaacattacaatgaaatgggatgttatgagctggactcctgatggctatgttgccgtggttacgatgttcaacttccagaaatacagacacattcaatctccaggatggacattaggttggaaatgggcaaagaaggaagttatatggagtatggttggagcacaaacaactgaacaaggtgattgttcaaagtacaaaggaaacataccacattgttgtaagaaggatccaacagttgtagacttgcttccagggactccttataatcagcagattgctaattgctgcaagggtggtgttatgaactcatgggttcaagaccctgccactgcggctagctccttccagattagtgttggtgctgctggaaccacaaacaaaaccgttagggtcccaagaaacttcactctcatgggacctggtccaggttacacttgtggtccagcaaagattgtcagaccaacaaaatttgtcacgactgacacacgcagaaccactcaagctatgatgacatggaacattacgtgcacatactcgcagttccttgctcaaagaactccaacttgctgtgtttctttatcttctttctacaatgaaaccattgttggatgtccaacttgtgcttgcggatgtcaaaacaacagaacagaatccggtgcctgcctcgacccggacacaccacacttagcctcggttgtgtcaccaccaacaaagaaaggaacggttttaccaccattagtgcaatgcacgagacacatgtgcccgatcagagtgcattggcatgtaaagcagaactacaaagagtattggcgtgtgaagatcacaatcacaaacttcaactatcgcttgaactacacacaatggaaccttgttgctcaacatccaaatctcgacaacatcactcaaatcttcagcttcaactacaaatctcttactccttacgctggactaaacgatacggcgatgttatggggagtgaagttctacaacgatttcttatcagaagcaggtcctcttgggaatgttcaatcagagattttgttccgtaaagaccaatcaaccttcacattcgagaaaggttgggcttttccacgaaggatttactttaatggagacaattgcgtcatgcctcctccagactcttacccttttcttcccaacggtggttcccggtcacaattctcattcgtcgccgccgtgctcctccctcttcttgtctttttcttcttctctgcctaatctcggatttacggttttgccactggtttgcttagggttacggcggagtggtataaacgtttatttatgattcttttgtgtcccacaaaaattataatcttttgatactttttaaaaatataaatagttttcaacttccttgtttttaaaagaaatttatatccttgtgttctgttggtccgtcgttgtagaatatcg

SEQ ID NO: 356 - protein, 456 aa, Arabidopsis thaliana
  misc_feature (1)..(456): Ceres CDNA ID no. 13601536
  misc_feature (1)..(456): Sequence of endogenous gene to Ceres PROMOTER  YP0133
MESFFSRSTSIVSKLSFLALWIVFLISSSSFTSTEAYDALDPEGNITMKWDVMSWTPDGYVAVVTMFNFQKYRHIQSPGWTLGWKWAKKEVIWSMVGAQTTEQGDCSKYKGNIPHCCKKDPTVVDLLPGTPYNQQIANCCKGGVMNSWVQDPATAASSFQISVGAAGTTNKTVRVPRNFTLMGPGPGYTCGPAKIVRPTKFVTTDTRRTTQAMMTWNITCTYSQFLAQRTPTCCVSLSSFYNETIVGCPTCACGCQNNRTESGACLDPDTPHLASVVSPPTKKGTVLPPLVQCTRHMCPIRVHWHVKQNYKEYWRVKITITNFNYRLNYTQWNLVAQHPNLDNITQIFSFNYKSLTPYAGLNDTAMLWGVKFYNDFLSEAGPLGNVQSEILFRKDQSTFTFEKGWAFPRRIYFNGDNCVMPPPDSYPFLPNGGSRSQFSFVAAVLLPLLVFFFFSA

SEQ ID NO: 357 - DNA, 1000 bp, Arabidopsis thaliana
  misc_feature (1)..(1000): Predicted sequence of Ceres PROMOTER  YP0137
tggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaacttatgaatctttacttaatatatacaacatatctttaccttgcggcggagaagatcggcgagagaagcaccccagccaccgtcactaaaggattcttcagtgatggaatcaccaaagagaaaaatcttccgtctcatcatcttccacacaatcttcttgagaaaatctgagagataagataggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttaaattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 358 - DNA, 1001 bp, Arabidopsis thaliana
  misc_feature (1)..(1001): Experimental sequence of Ceres PROMOTER  YP0137
gtggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaactgatgaatctttacttaatatatacaacatatctttaccttgcggcggagaagatcggcgagagaagcaccccagccaccgtcactaaaggattcttcagtgatggaatcaccaaagagaaaaaccttccgtctcatcatcttccacacaatcttcttgagaaaatctgagagataagaaaggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttagattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 359 - DNA, 1277 bp, Arabidopsis thaliana
  misc_feature: Encoded by SEQ ID NO: 358
  misc_feature (1)..(1277): Ceres CDNA ID no. 13603975
  misc_feature (1)..(1277): Sequence of endogenous gene to Ceres PROMOTER  YP0137
aactgaatttgaaagaaaaaaaaaaagaaatcataaaatgagaatcaatatgttattcatagtggcattctcatttttagtctctgttcggtcattaccgatgagaccaactctaaagtacgagtcaatctttaattttggcgattctttaagcgataccggaaactttttattatccggtgatgttgactctccgaacattggaagactaccgtacggacaaaccttttttaaccgttccaccggtcgttgctctgacggacgtctcatcatcgatttcatcgctgaggctagtggactaccgtacattccaccgtatctccaaagcttacggacgaatgattcggtagatttcaagagaggtgcaaattttgcggtggctggagcaacagcgaacgaatttagcttctttaaaaacagaggtctttcagtaacattgttgacaaacaagacactggatattcaacttgattggttcaagaagttgaaaccttctctgtgtaaaaccaagccagaatgtgaacaatattttagaaaatctctatttctcgttggagaaattggtggaaacgattataactaccctcttttggcattccgaagtttcaaacatgctatggatttggtaccatttgttattaacaaaatcatggacgtcacaagtgcattgatagaggaaggtgccatgacactaatagttccaggaaaccttccaatcggttgttctgcggctctactagagcggtttaatgataatagtggatggctttatgactcgaggaaccaatgctacatgccattgaacaatttggctaagcttcacaatgataagctcaagaaaggcctcgcggctctaagaaaaaagtacccttatgccaaaattatatatgctgattattacagttctgccatgcaattcttcaactcaccttccaaatacggtttcactggaagtgtcctaaaggcatgttgtggaggaggagatggaagatacaacgtgcaaccaaacgtgcggtgcggagaaaagggttcaaccacttgcgaagatccatcaacgtacgcaaattgggacggaattcacctcactgaagcggcttaccgccacattgcaactggtctcatctccggccgtttcaccatgcctacttataattaataacaattaagttactcataagttgtaactttttttttaacacacaaacttttcatataactcctaattgaaaacctataaatcgatcatatttatatcaagctcgttcgagagcataagc

SEQ ID NO: 360 - protein, 372 aa, Arabidopsis thaliana
  misc_feature (1)..(372): Ceres CDNA ID no. 13603975
  misc_feature (1)..(372): Sequence of endogenous gene to Ceres PROMOTER  YP0137
MRINMLFIVAFSFLVSVRSLPMRPTLKYESIFNFGDSLSDTGNFLLSGDVDSPNIGRLPYGQTFFNRSTGRCSDGRLIIDFIAEASGLPYIPPYLQSLRTNDSVDFKRGANFAVAGATANEFSFFKNRGLSVTLLTNKTLDIQLDWFKKLKPSLCKTKPECEQYFRKSLFLVGEIGGNDYNYPLLAFRSFKHAMDLVPFVINKIMDVTSALIEEGAMTLIVPGNLPIGCSAALLERFNDNSGWLYDSRNQCYMPLNNLAKLHNDKLKKGLAALRKKYPYAKIIYADYYSSAMQFFNSPSKYGFTGSVLKACCGGGDGRYNVQPNVRCGEKGSTTCEDPSTYANWDGIHLTEAAYRHIATGLISGRFTMPTYN

SEQ ID NO: 361 - DNA, 1019 bp, Arabidopsis thaliana
  misc_feature (1)..(1019): Predicted sequence of Ceres PROMOTER  YP0144
agtcgattggaaacgttgcaagattattgattgtgagaagagtgctcaaggtagtactgatttctgtaaagctcacggtggtgggaaacgatgttcttggggagatgggaaatgtgagaaatttgctagaggaaagagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaaccattgcact

SEQ ID NO: 362 - DNA, 1003 bp, Arabidopsis thaliana
  misc_feature (1)..(1003): Experimental sequence of Ceres PROMOTER  YP0144
aaacgttgcaagattattgattgtgagaaagagtgctcaaggtagtactgatttctgtaaagctcacggtggtgggaaacgatgttcttggggagatgggaaatgtgagaaaatttgctagaggaaagaagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaat

SEQ ID NO: 363 - DNA, 1268 bp, Arabidopsis thaliana
  misc_feature: Encoded by SEQ ID NO: 362
  misc_feature (1)..(1268): Ceres CDNA ID no. 12705120
  misc_feature (1)..(1268): Sequence of endogenous gene to Ceres PROMOTER  YP0144
aaaactcttaaacagcttcctaacgagaggaaactgaggaacacaacaatggagtttcgtggagatgccaaccagaggattgctaggatttcagctcatctcactcctcagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtccgcgggttcttgggagcgaagcagcttgaggacgcgctaacgggtatggatcttgtgatcataccagccggtataccgaggaaaccagggatgacccgcgatgatctgtttaaaatcaatgctgggattgttaaaacactatgtgaaggtgtagcaaaatgttgtcctaatgctattgtcaacttgatcagcaaccctgtgaactctactgtccccattgccgctgaggttttcaagaaagctggaacttatgatcctaagaagctccttggagttactacactcgatgttgctcgtgccaacacatttgtggcagaagttcttggccttgatccaagagaagtcgatgtgccagtagttgggggacacgccggagtcacaatcttgccactactgtcacaggttaaacctcctagcagcttcacacctcaagaaattgagtacctgacaaaccggattcaaaatggtggaactgaagttgtggaggcaaaagctggagctggttctgcaacactttcaatggcatatgctgcagccaagtttgcagatgcttgccttcgcgggttaagaggagatgcgaatgtcgtagaatgctcttttgttgcttcacaggtgacagaattagctttctttgcaacaaaagtgcgccttggccgtacaggagcagaggaagtgtatcagcttggacccttaaacgaatacgaaaggattggtctggagaaagcaaaagatgaattagccggaagtattcagaaaggtgttgaattcatcagaaaatgaaactgagagataatcagagagatacaataagttatttcctcaactatatgatcatgtactcatcatcacatcatgcctatgtctcctctgcttctgatacaactttgtataaatccttatcagtttgtgtacgatatatgtgaccttttcaacgt

SEQ ID NO: 364 - protein, 354 aa, Arabidopsis thaliana
  misc_feature (1)..(354): Ceres CDNA ID no. 12705120
  misc_feature (1)..(354): Sequence of endogenous gene to Ceres PROMOTER  YP0144
MEFRGDANQRIARISAHLTPQMEAKNSVIGRENCRAKGGNPGFKVAILGAAGGIGQSLSLLMKMNPLVSLLHLYDVVNAPGVTADVSHMDTGAVVRGFLGAKQLEDALTGMDLVIIPAGIPRKPGMTRDDLFKINAGIVKTLCEGVAKCCPNAIVNLISNPVNSTVPIAAEVFKKAGTYDPKKLLGVTTLDVARANTFVAEVLGLDPREVDVPVVGGHAGVTILPLLSQVKPPSSFTPQEIEYLTNRIQNGGTEVVEAKAGAGSATLSMAYAAAKFADACLRGLRGDANVVECSFVASQVTELAFFATKVRLGRTGAEEVYQLGPLNEYERIGLEKAKDELAGSIQKGVEFIRK

SEQ ID NO: 365 - DNA, 999 bp, Arabidopsis thaliana
  misc_feature (1)..(999): Predicted sequence of Ceres PROMOTER  YP0143
atacaacagatggcagatatcgagttaaatatgtgaatcagccgttacgatattttaaaactagaaaattatttaaaaatattgcaaaataccatttaatttcattgttcataaaaaaaagaaatttaaaaacttaaaaactgattcaaaaatttggattaattatcgttaacagtcttcaacactacaacaacatgtttctaatttattttatattttaataattaaacaatatatacgtctgcacattgttgctccgacataatctagtataaaaatagttgcagcatatgtgaaaagcaagcagcatttattactcaatacttataattttatttgttgtatgtattaaggttttgtagctttaagaaaacgcttataatataaaataacttctagaagatatttcatgcgtatacaataaatatttgtgaaaaaacatttcgaaaacgtgtacaacatataaactattgtgttatcttttgacattcaaacaaatgttgacaatgtaattttatccatgatatgattggccaattagctgcgaggtaaaaatccgtatacgagtaaaagtaagataaaatttcgcaagaagaattttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaa

SEQ ID NO: 366 - DNA, 576 bp, Arabidopsis thaliana
  misc_feature (1)..(576): Experimental sequence of Ceres PROMOTER  YP0143
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaa

SEQ ID NO: 367 - DNA, 1225 bp, Arabidopsis thaliana
  misc_feature: Encoded by SEQ ID NO: 366
  misc_feature (1)..(1225): Ceres CDNA ID no. 13607229
  misc_feature (1)..(1225): Sequence of endogenous gene to Ceres PROMOTER  YP0143
attttaaaagtatcagtttacactgacacaatccttaactattttcctttgttcttcttcatctttattacacatttttttcaaggtctaccaaacgatgtcggttttcgaatcggagacttcgaacttccacgtctacaacaaccacgaaatccaaacgcaaccgcaaatgcaaacgtttctgtcggaggaggaaccggtagggagacagaactcgattttgtcactaactcttgacgaaattcagatgaaaagcggtaagagctttggagcgatgaacatggacgagttcctagcgaacttgtggacaaccgttgaagaaaacgacaacgaaggaggtggggctcacaacgacggagagaagccggcggtgctgccacgtcaagggtcgttgtccctccctgtgcctttatgcaagaaaacggtcgacgaggtttggctcgagatacaaaacggtgtacaacaacatccaccgtcgtcgaattccggtcaaaactccgccgaaaatattcgccggcaacaaacccttggtgagatcactctcgaggattttcttgttaaggctggtgttgtacaagaaccgttgaagacaacgatgaggatgtcgagttctgattttggttataaccccgagtttggagttggtttacattgtcagaaccaaaacaattatggtgataaccggtcggtttatagtgaaaaccgaccgttttactcggttttgggagaatcttcaagctgtatgaccgggaatgggaggagtaatcagtatctgaccggtttagatgcttttcggatcaagaaacggataattgatggtccacctgaaattttgatggagcggagacaacggcgaatgattaaaaaccgcgaatctgcggctcggtctcgagcccggagacaagcttatactgtggaactggagttggaattgaacaacctcacggaagaaaacacgaagctgaaggaaattgtggaggaaaatgagaagaaaagaagacaagagataataagtagaagcaaacaagtgactaaagagaagagcggagacaaattgagaaagattcggaggatggccagtgccgggtggtaaatagatatgagagtttgtgtaatttacatatgatattttattgatcgtttctatctatacacataaatatttgtatctatattatattttgagacaaacatggaatttgtgtatataggatcatttcttttt

SEQ ID NO: 368 - protein, 331 aa, Arabidopsis thaliana
  misc_feature (1)..(331): Ceres CDNA ID no. 13607229
  misc_feature (1)..(331): Sequence of endogenous gene to Ceres PROMOTER  YP0143
MSVFESETSNFHVYNNHEIQTQPQMQTFLSEEEPVGRQNSILSLTLDEIQMKSGKSFGAMNMDEFLANLWTTVEENDNEGGGAHNDGEKPAVLPRQGSLSLPVPLCKKTVDEVWLEIQNGVQQHPPSSNSGQNSAENIRRQQTLGEITLEDFLVKAGVVQEPLKTTMRMSSSDFGYNPEFGVGLHCQNQNNYGDNRSVYSENRPFYSVLGESSSCMTGNGRSNQYLTGLDAFRIKKRIIDGPPEILMERRQRRMIKNRESAARSRARRQAYTVELELELNNLTEENTKLKEIVEENEKKRRQEIISRSKQVTKEKSGDKLRKIRRMASAGW

SEQ ID NO: 369 - DNA, 999 bp, Arabidopsis thaliana
  misc_feature (1)..(999): Predicted sequence of Ceres PROMOTER  YP0156
tttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctaatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacaccttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcagaggcacagtttaaagttcgagtgtaacagtttctaaggc

SEQ ID NO: 370 - DNA, 1004 bp, Arabidopsis thaliana
  misc_feature (1)..(1004): Experimental sequence of Ceres PROMOTER  YP0156
ttggtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctgatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacactttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcggaggcacagtttaaagttcgagtgtaacagtttctaaggca

SEQ ID NO: 371 - DNA, 1267 bp, Arabidopsis thaliana
  misc_feature: Encoded by SEQ ID NO: 370
  misc_feature (1)..(1267): Ceres CDNA ID no. 12323871
  misc_feature (1)..(1267): Sequence of endogenous gene to Ceres PROMOTER  YP0156
aaaataagctctctttctactatttctctttctctttctactatttctctcctgtggagaaactcaggagatagagagagagagagagaagagaagagagcatgtatgtttggttttataatctctctactcataccaaagatttgtctcagacccaccacttggacagagagaacccaagctcctttctctctttttctcgatctactccttcttaatctccttttttgaaacttgaagccactttcaacatcatccttaaacttttgttcccttattcacaatctcctgccacctctcatttctctagctacatatatgggttctattagaggaaacattgaagagcctatatctcagtcattaacgaggcagaactctctctatagcttaaagctccatgaggttcaaacccacttaggaagttctggaaaaccactaggaagcatgaaccttgatgagcttctcaagactgtcttgccaccagctgaggaagggcttgttcgtcagggaagcttgacgttacctcgagatctcagtaaaaagacagttgatgaggtctggagagatatccaacaggacaagaatggaaacggtactagtactactactactcataagcagcctacactcggtgaaataacacttgaggatttgttgttgagagctggtgtagtgactgagacagtagtccctcaagaaaatgttgttaacatagcttcaaatgggcaatgggttgagtatcatcatcagcctcaacaacaacaagggtttatgacatatccggtttgcgagatgcaagatatggtgatgatgggtggattatcggatacaccacaagcgcctgggaggaaaagagtagctggagagattgtggagaagactgttgagaggagacagaagaggatgatcaagaacagagaatctgcagcacgttcacgagctaggaaacaggcttatacacatgaattagagatcaaggtttcaaggttagaagaagaaaacgaaaaacttcggaggctaaaggaggtggagaagatcctaccaagtgaaccaccaccagatcctaagtggaagctccggcgaacaaactctgcttctctctgatcctaaagactcttctttctttcttcttctttgtgttggtttatatcagaccgctttgttctttgtatattgtgtagactttattgactttgaacagcatgtctttataaacatttcttgagtgtattcctcttttgcagctagttcaaactttttgagt

SEQ ID NO: 372 - protein, 262 aa, Arabidopsis thaliana
  misc_feature (1)..(262): Ceres CDNA ID no. 12323871
  misc_feature (1)..(262): Sequence of endogenous gene to Ceres PROMOTER  YP0156
MGSIRGNIEEPISQSLTRQNSLYSLKLHEVQTHLGSSGKPLGSMNLDELLKTVLPPAEEGLVRQGSLTLPRDLSKKTVDEVWRDIQQDKNGNGTSTTTTHKQPTLGEITLEDLLLRAGVVTETVVPQENVVNIASNGQWVEYHHQPQQQQGFMTYPVCEMQDMVMMGGLSDTPQAPGRKRVAGEIVEKTVERRQKRMIKNRESAARSRARKQAYTHELEIKVSRLEEENEKLRRLKEVEKILPSEPPPDPKWKLRRTNSASL

SEQ ID NO: 373 - DNA, 1012 bp, Arabidopsis thaliana
  misc_feature (1)..(1012): Predicted sequence of Ceres PROMOTER  YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctatgtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgctccattgcactggt

SEQ ID NO: 374 - DNA, 1000 bp, Arabidopsis thaliana
  misc_feature (1)..(1000): Experimental sequence of Ceres PROMOTER  YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctaggtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgcta

SEQ ID NO: 375 - DNA, 2353 bp, Arabidopsis thaliana
  misc_feature: Encoded by SEQ ID NO: 374
  misc_feature (1)..(2353): Ceres CDNA ID no. 13602983
  misc_feature (1)..(2353): Sequence of endogenous gene to Ceres PROMOTER  YP0158
ctgtgtctttatcttctctctcctcttcttgaaaaactgaacctttaattctttcttcacatctcctttagctttctgaagctgctatcttcaagctcaaaaccaaaccctagaaataaaatgacggcgacacaaatgctgcttcatcttcttcttcttccacttctcttccttcacttcagcaaccaagtcatggcagaaatcaccgacgagttagcgacattgatggaggttaaaacagagcttgacccagaagacaaacacttagcttcatggagtgttaatggagatctgtgtaaagactttgaaggtgttggttgtgactggaaaggacgagtttctaacatatctctacaagggaaaggcttatctggtaaaatctctccgaacattggaaagcttaaacatttgacgggtttgttcttgcactacaatgctcttgttggagatattcctagagaacttggtaacttgtcggaacttacggatctttatctcaatgttaataatctctccggtgagattccttcaaacattgggaagatgcaaggcttgcaagttttgcagctctgttacaacaatttgactggaagcattcctagggagcttagttcactgaggaagctgagtgttcttgctcttcaatctaacaaactcactggagctatacctgcgagtttaggagatttaagtgctctagagcggctagatttgagctacaatcatttgtttggttctgtaccaggcaagttagctagccctcctctgcttcgagttctcgacatccgcaacaactccctcactggcaatgtacctcctgtactgaagagattaaatgaaggtttttcgtttgaaaacaacttgggactatgtggagctgagttctcgccgttgaaatcttgcaatggcacagctcctgaggaacctaagccatacggtgcaaccgtgtttggttttccatcccgggatataccagaatcagctaatctacggtcaccttgtaatggaacaaactgtaatactcctccaaaatctcaccaaggtgcaatccttattggtttggttgtctcgactattgcattgtctgctattagcatcctcttgttcacgcattatcgcagacgcaaacagaagctttcaaccacttatgaaatgtcggacaaccgtctcaacaccgtaggaggaggttttaggaagaacaatggttctccattggccagtcttgaatatactaatggttgggatccactttcagacaataggaatctcagtgtctttgctcaagaagttatccagagctttcgattcaatcttgaagaggttgaaactgctacacagtatttctcagaagtgaatttgcttggaagaagcaacttctctgcgacttacaaaggaatcttgagagatggttctgctgtagcgatcaaacggtttagtaaaacaagttgcaaatctgaagaacctgagttcttgaaaggactcaacatgttggcgtctctgaaacatgaaaacttgtcaaaacttagaggcttctgctgttcaagaggccgtggagaatgttttctcatctatgattttgctcctaatggaaatttactgagctatcttgatctcaaagatggtgatgcgcatgttcttgattggtccacgagagtatccattgctaaaggcatcgcaaaagggattgcttatctacattcatacaaaggaagcaagccagcattggttcaccaaaacatctcagcggagaaagttctaatcgaccagcgatacagtcctctactctcaaactcaggcctccacacacttctcacaaacgacattgtcttctctgcactcaaagacagtgcagcaatgggctacctcgctccagaatacaccacaaccggacgtttcaccgagaaaaccgatgtctacgctttcgggattcttgtgtttcagataatctccgggaaacagaaggttaggcatcttgttaagcttggaactgaagcttgtaggttcaatgattacatagatccaaatcttcaaggaagattctttgaatatgaagccacaaagctagctagaatcgcgtggctatgcactcatgaatctcccattgaaagaccatccgtggaagctgtagttcatgagctaggtaactgtagtagctgtctctgagaactctctcgaggcaaatgtgtaatgtgtaccttaggaatcaattaaggaagggtttgttagtcaccttttcctgtgtttagggttaagaaaaaggtgccttttcccttcccattaacgtttaaaaactgttcaacgtgttgtactttattggtttgtatgatttgtgtttatgttaagctcttcaacc

SEQ ID NO: 376 - protein, 680 aa, Arabidopsis thaliana
  misc_feature (1)..(680): Ceres CDNA ID no. 13602983
  misc_feature (1)..(680): Sequence of endogenous gene to Ceres PROMOTER  YP0158
MTATQMLLHLLLLPLLFLHFSNQVMAEITDELATLMEVKTELDPEDKHLASWSVNGDLCKDFEGVGCDWKGRVSNISLQGKGLSGKISPNIGKLKHLTGLFLHYNALVGDIPRELGNLSELTDLYLNVNNLSGEIPSNIGKMQGLQVLQLCYNNLTGSIPRELSSLRKLSVLALQSNKLTGAIPASLGDLSALERLDLSYNHLFGSVPGKLASPPLLRVLDIRNNSLTGNVPPVLKRLNEGFSFENNLGLCGAEFSPLKSCNGTAPEEPKPYGATVFGFPSRDIPESANLRSPCNGTNCNTPPKSHQGAILIGLVVSTIALSAISILLFTHYRRRKQKLSTTYEMSDNRLNTVGGGFRKNNGSPLASLEYTNGWDPLSDNRNLSVFAQEVIQSFRFNLEEVETATQYFSEVNLLGRSNFSATYKGILRDGSAVAIKRFSKTSCKSEEPEFLKGLNMLASLKHENLSKLRGFCCSRGRGECFLIYDFAPNGNLLSYLDLKDGDAHVLDWSTRVSIAKGIAKGIAYLHSYKGSKPALVHQNISAEKVLIDQRYSPLLSNSGLHTLLTNDIVFSALKDSAAMGYLAPEYTTTGRFTEKTDVYAFGILVFQIISGKQKVRHLVKLGTEACRFNDYIDPNLQGRFFEYEATKLARIAWLCTHESPIERPSVEAVVHELGNCSSCL

SEQ ID NO: 377 - DNA, 1017 bp, Arabidopsis thaliana
  misc_feature (1)..(1017): Predicted sequence of Ceres PROMOTER  YP0164
agtcgattgggtcgattggcattactagagttttagatttcacagaattcttttctttgtttggtctgttcgtcctctactgtgtttttcttttgttttggctattttgccgtctgttaaaaaattggggttttccgataatgtattgtatatgcctgaattatggaaatatcactaaaaacacttttttgcacttttgtatatattgcaattaagatttaatttttctattttgaagactttttgttaaaagagagatttgctaactcaaaattaccggagttaataagttcgttctcatcagattagcaaaacattcatctttaaagaaatctgtttatctcacgtaaaattctactaattggcagcagcgcactactttaatgggcctattactatttcaatatgcactgaaaacttcattggactgtccaataacattataacattattaaaactaaactacatttgtatttgggttacaattttataaagagtaagactcaagatactaattgggctgcagacaactttaaaagccttactacaaaaatcaaaaccattcttaattaactaacaaccaggtaaaaatctcagtacaatatttacactaaaaataggtgccacccactatgcaaaagtttagggccacgaacaaaaaaacctgtaaattgttatgtcttcacaatatgtgttttaatacacatgaattttagctgcggttaatgtaaattttgtagttaaattaaggctaaacaatctcaaatataaattggtcaggtccacagacaacagcctggcaagtggcaagcactaaaaattcgaccgttattttttgcccctttttttaatatttcgaaattgtatcttttagttttattttaaagctttttagcccgctcctcctccgctccacctttaattttttcaccaattggatttggatctgtcaaaaatattggcctctttctctctttctctcttgctctctttctttgttgggttgaccattgcact

SEQ ID NO: 378 - DNA, 997 bp, Arabidopsis thaliana
  misc_feature (1)..(997): Experimental sequence of Ceres PROMOTER  YP0164
gtcgattggcattactagagttttagatttcacagaattcttttctttgtttggtctgttcgtcctctactgtgtttttcttttgttttggctattttgccgtctgttaaaaaattggggttttccgataatgtattgtatatgcctgaattatggaaatatcactaaaaacacttttttgcacttttgtatatattgcaattaagatttaatttttctattttgaagactttttgttaaaagagagatttgctaactcaaaattaccggagttaataagttcgttctcatcagattagcaaaacattcatctttaaagaaatctgtttatctcacgtaaaattctactaattggcagcagcacactactttaatgggcctattactatttcaatatgcactgaaaacttcattggactgtccaataacattataacattattaaaactaaactacatttgtatttgggttacaattttataaagagtaagactcaagatactaattgggctgcagacaactttaaaagccttactacaaaaatcaaaaccattcttaattaactaacaaccaggtaaaaatctcagtacaatatttacactaaaaataggtgccacccactatgcaaaagtttagggccacgaacaaaaaaacctgtaaattgttatgtcttcacaatatgtgttttaatacacatgaattttagctgcggttaatgtaaattttgtagttaaattaaggctaaacaatctcaaatataaattggtcaggtccacagacaacagcctggcaagtggcaagcactaaaaattcgaccgttattttttgcccctttttttaatatttcgaaattgtatcttttagttttattttaaagctttttagcccgctcctcctccgctccacctttaattttttcaccaattggatttggatctgtcaaaaatattggcctctttctctctttctctcttgctctctttctttgttgggttga

SEQ ID NO: 379 - DNA, 1135 bp, Arabidopsis thaliana
  misc_feature: Encoded by SEQ ID NO: 378
  misc_feature (1)..(1135): Ceres CDNA ID no. 12385295
  misc_feature (1)..(1135): Sequence of endogenous gene to Ceres PROMOTER  YP0164
acctttaattttttcaccaattggatttggatctgtcaaaaatattggcctctttctctctttctctcttgctctctttctttgttgggttgatctcttcttccatggcgatccctacggagacacaacaccaggagaaggaggcttcagatgcttctgcagcagctgcacaaaagagatggactttaagcgatttcgacatcggtaagcctcttggcagaggcaaattcggtcacgtctatctcgccagagaaaaacggagcaatcacgttgtcgctctaaaggttcttttcaagagccagcttcaacaatcccaagttgaacatcagctcagaagagaagttgagattcagtctcatcttcgtcaccccaacatactccggctttatggctatttctatgatcaaaaaagagtttatttgatacttgagtatgctgctagaggcgaactttacaaggatcttcagaaatgcaaatacttcagcgaaagacgagctgctacttatgttgcctcattggcgagggctctcatctattgccatggcaagcatgtgatacacagagatattaaaccagagaatctgctaattggtgctcagggtgagctcaagattgcagactttggttggtcggtacacacatttaaccgaagaaggaccatgtgtggcacactagattaccttcctcctgagatggtcgaaagcgtagaacatgatgctagtgtagatatctggagccttgggattctctgttacgagtttctttatggtgtacctccttttgaagccatggagcactcagacacatacagaaggattgtgcaagtggatctcaagttccctcccaaaccaataatctctgcatctgcaaaggatcttattagccagatgcttgtcaaggagtcttcgcaacgtctgccattgcacaagcttctggagcatccgtggatcgtgcaaaacgctgatccttctggaatctacagagtttaaaaacaaaacgcttactgttctcgccaatctcgaccaaaactgttatctagaaacccaaaactgtattctttcttactattatttttcgctaattcatgttccaaataatgtgtattatgtagtatgtactaatactatatggcatt

SEQ ID NO: 380 - protein, 294 aa, Arabidopsis thaliana
  misc_feature (1)..(294): Ceres CDNA ID no. 12385295
  misc_feature (1)..(294): Sequence of endogenous gene to Ceres PROMOTER  YP0164
MAIPTETQHQEKEASDASAAAAQKRWTLSDFDIGKPLGRGKFGHVYLAREKRSNHVVALKVLFKSQLQQSQVEHQLRREVEIQSHLRHPNILRLYGYFYDQKRVYLILEYAARGELYKDLQKCKYFSERRAATYVASLARALIYCHGKHVIHRDIKPENLLIGAQGELKIADFGWSVHTFNRRRTMCGTLDYLPPEMVESVEHDASVDIWSLGILCYEFLYGVPPFEAMEHSDTYRRIVQVDLKFPPKPIISASAKDLISQMLVKESSQRLPLHKLLEHPWIVQNADPSGIYRV

SEQ ID NO: 381 - DNA, 1095 bp, Arabidopsis thaliana
  misc_feature (1)..(1095): Predicted sequence of Ceres PROMOTER  YP0016
aaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccccattgcactggcaccactacaaccaccgcaacaaccaccaaaaaccctctcaaagaaatttcttttttttcttactttcttggtttgtcaaata

SEQ ID NO: 382 - DNA, 1129 bp, Arabidopsis thaliana; identical to SEQ ID NO: 157
  misc_feature (1)..(1129): Experimental sequence of Ceres PROMOTER  YP0016

SEQ ID NO: 383 - DNA, 1907 bp, Arabidopsis thaliana
  misc_feature: Encoded by SEQ ID NO: 382
  misc_feature (1)..(1907): Ceres CDNA ID no. 13491988
  misc_feature (1)..(1907): Sequence of endogenous gene to Ceres PROMOTER  YP0016
gtctcctcttcggataatcctatccttctcttcctataaatacctctccactcttcctcttcctccaccactacaaccaccgcaacaaccaccaaaaaccctctcaaagaaatttcttttttttcttactttcttggtttgtcaaatatggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcattgaattttagcagtggttgtttggctctctttctctcataaaacagtagtgttgtgcaaatcctacataaagaaaaaagaaaaggaaattaaactcattgggttggtttgtattttacctaaacccacgaagttcctttttctttttgtaactcaatttaaatttggagtatattttactttttgttaccttcaaggcttcaatattacgacttcattgttcgg

SEQ ID NO: 384 - protein, 512 aa, Arabidopsis thaliana
  misc_feature (1)..(512): Ceres CDNA ID no. 13491988
  misc_feature (1)..(512): Sequence of endogenous gene to Ceres PROMOTER  YP0016
MVSHPMEKAANGASALETQTGELDQPERLRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGEIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLALTVLPSPPPDAPAFKATMGFH

SEQ ID NO: 385 - DNA, 999 bp, Arabidopsis thaliana
  misc_feature (1)..(999): Predicted sequence of Ceres PROMOTER  YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatca

SEQ ID NO: 386 - DNA, 1000 bp, Arabidopsis thaliana
  misc_feature (1)..(1000): Experimental sequence of Ceres PROMOTER  YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaa

SEQ ID NO: 387 - DNA, 1209 bp, Arabidopsis thaliana
  misc_feature: Encoded by SEQ ID NO: 388
  misc_feature (1)..(1209): Ceres CDNA ID no. 13607852
  misc_feature (1)..(1209): Sequence of endogenous gene to Ceres PROMOTER  YP0119
gttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttctcctcataacgattaagagagagacgagagagttcattttatatttataacgcgactgtgtattcatagtttaggttctaataatgataataacaaaactgttgtttctttgctt

SEQ ID NO: 388 - protein, 248 aa, Arabidopsis thaliana
  misc_feature (1)..(248): Ceres CDNA ID no. 13607852
  misc_feature (1)..(248): Sequence of endogenous gene to Ceres PROMOTER  YP0119
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 389 - DNA, 999 bp, Arabidopsis thaliana
  misc_feature (1)..(999): Predicted sequence of Ceres PROMOTER  YP0171
aatgaaaacaatgggagaagtacatgcttgtcctcacacactaatgccgatgaggaaagcgtttaaggggacttttatctccgcaggaggtttcacgagggaagatgggaatgaggctgtgtcaaagggaagaactgatttggtggcttatggtcgatggtttctagccaacccggacctgccaaagaggttccaagtggatgcaccgctgaataagtacgatagaccaacgttttacacttctgatccagtcgtcggttacaccgattaccctttcctcgaatcaacagcttaaaattgttatcaataatgtaatgtagtgtgtttcccttatataagatgtaataagtttctggcttttcatttatactttttaagtttaagtcataaaaccttcacaaaaatttccacggacacattatcacaaaagcgctttctagagaccaacataacttaacttgattgttgatttctgtttgatgtgatcatgccgcaatccagtgtgttctcatgatgctatcttccctcctttcacatgctgcacagaacaaaacagagcattttcctcccaactatacctaattttttttggtcggtggtcaaagttatacatcggaagaatctgttgaaatcatattgaggcccctcatttgttatgttatgtaatctccaatggatcaaaagtagaatcccaactgtagaagatgatactatcatgctaggtagaagacagcatggaatatggggtaagttcaaagtggttacactctaatgtcgtctcaacgaatacgtctttatgaagaaataaaaaaatctaagtggttggatgcgtcatcaatgacgaccacgtcgttaaagacagaaagaaacacttgcgttcctgattctctgatcaatcaatgtgtataaatatgttcggatatgtccattatcttacgcaatcttgaaaagtgtttttgagagaaatataggttttacaaaatccaccgttgtgaattc

SEQ ID NO: 390 - DNA, 1000 bp, Arabidopsis thaliana
  misc_feature (1)..(1000): Experimental sequence of Ceres PROMOTER  YP0171
aatgaaaacaatgggagaagtacatgcttgtcctcacacactaatgccgatgaggaaagcctttaaggggacttttatctccgcaggaggtttcacgagggaagatgggaatgaggctgtgtcaaagggaagaactgatttggtggcttatggtcgatggtttctagccaacccggacctgccaaagaggttccaagtggatgcaccgctgaataagtacgatagaccaacgttttacacttctgatccagtcgtcggttacaccgattaccctttcctcgaatcaacagcttaaaattgttatcaataatgtaatgtagtgtgtttcccttatataagatgtaataagtttctggcttttcatttatactttttaagtttaagtcataaaaccttcacaaaaatttccacggacacattatcacaaaagcgctttctagagaccaacataacttaacttgattgttgatttctgtttgatgtgatcatgccgcaatccagtgtgttctcatgatgctatcttccctcctttcacatgctgcacagaacaaaacagagcattttcctcccaactatacctaattttttttggtcggtggtcaaagttatacatcggaagaatctgttgaaatcatattgaggcccctcatttgttatgttatgtaatctccaatggatcaaaagtagaatcccaactgtagaagatgatactatcatgctaggtagaagacagcatggaatatggggtaagttcaaagtggttacactctaatgtcgtctcaacgaatacgtctttatgaagaaataaaaaaatctaagtggttggatgcgtcatcaatgacgaccacgtcgttaaagacagaaagaaacacttgcgttcctgattctctgatcaatcaatgtgtataaatatgttcggatatgtccattatcttacgcaatcttgaaaagtgtttttgagagaaatataggttttacaaaatccaccgttgtgaattca

SEQ ID NO: 391 - DNA, 1313 bp, Arabidopsis thaliana
  misc_feature: Encoded by SEQ ID NO: 391
  misc_feature (1)..(1313): Ceres CDNA ID no. 13619728
  misc_feature (1)..(1313): Sequence of endogenous gene to Ceres PROMOTER  YP0171
aatcttgaaaagtgtttttgagagaaatataggttttacaaaatccaccgttgtgaattcatggaaatggtaaacgcagaagcaaaacagagtgtccctcttctcaccccttataagatgggaagattcaatctttctcatagggttgttctagcaccattgacgagacagaaatcgtacggaagcgttcctcagcctcacgctatcttgtattactctcagagaacgtcaccgggaggttttctcatcgctgaagccaccggggtttcagatacagctcaagggtatccagatacacctgggatatggactaaagagcatgtggaggcatggaagccaatcgttgatgctgtacatgccaaaggtggtatcttcttctgtcagatctggcatgttggccgcgtttctaatcgcggttttcagccaaggaggcaagctcctatctcttgtacggggaagccaattatgcctcaaatgcgtgctaatggcattgatgaagctcgctttacccctccaagacgtctaagtatcgaagaaatccccggcattgtcaatgattttaggcttgctgcaagaaatgctatggaagctggttttgatggagttgagattcatggagctcatggctatctgattgatcagttcatgaaggacaaagtgaatgacagaactgatgaatatggtggatcattgcaaaaccgttgcaaatttgctctggaagtagtcgatgcagtggctaaggagatcgggccagaccgtgttggaatcaggctctctccgtttgcagactatatggaatccggagacactaatccagaagcattagggctgtacatggtggaatctctgaacaaatatggaatcctctactgtcatatgattgaacccagaatgaaaacagtgggagaaatagcagcgtgttctcacacactaatgccaatgagggaagcctttaaggggactttcatctctgcaggaggtttcacgagggaagatgggaatgaggccgtggcaaagggacgaactgatcttgtggcttatggtcgatggtttctagccaacccagacctgccaaagcggttccaactggatgcaccgctgaataaatacaataggtcaacgttttacacttctgatcctgtcgtgggttacaccgattacccttcccttgaatcaacagcttaaaatcgtgttatcagtaatgtaatgtgtttccctaatgatgtaataagtttctggcttttgtttatactctaagtcattataccttcataataatttacatggatacattatcacaaaagagcttttat

SEQ ID NO: 392 - protein, 374 aa, Arabidopsis thaliana
  misc_feature (1)..(374): Ceres CDNA ID no. 13619728
  misc_feature (1)..(374): Sequence of endogenous gene to Ceres PROMOTER  YP0171
MEMVNAEAKQSVPLLTPYKMGRFNLSHRVVLAPLTRQKSYGSVPQPHAILYYSQRTSPGGFLIAEATGVSDTAQGYPDTPGIWTKEHVEAWKPIVDAVHAKGGIFFCQIWHVGRVSNRGFQPRRQAPISCTGKPIMPQMRANGIDEARFTPPRRLSIEEIPGIVNDFRLAARNAMEAGFDGVEIHGAHGYLIDQFMKDKVNDRTDEYGGSLQNRCKFALEVVDAVAKEIGPDRVGIRLSPFADYMESGDTNPEALGLYMVESLNKYGILYCHMIEPRMKTVGEIAACSHTLMPMREAFKGTFISAGGFTREDGNEAVAKGRTDLVAYGRWFLANPDLPKRFQLDAPLNKYNRSTFYTSDPVVGYTDYPSLESTA

SEQ ID NO: 393 - DNA, 1019 bp, Arabidopsis thaliana
  misc_feature (1)..(1019): Predicted sequence of Ceres PROMOTER  YP0188
agtcgattggtatgaaatttcggagaccaacaaaaaaaactttattgagcttggagtgaagctatatatatggggcaagatcataatatgtttatatcggccttttcattaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactgaccattgcact

SEQ ID NO: 394 - DNA, 364 bp, Arabidopsis thaliana
  misc_feature (1)..(364): Experimental sequence of Ceres PROMOTER  YP0188
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccc

SEQ ID NO: 395 - DNA, 1000 bp, Arabidopsis thaliana
  misc_feature (1)..(1000): Predicted sequence of Ceres PROMOTER  YP0258
taaataacttacttaaatttatattaaaaccgtttacatctgatataatttaaaaggttttagacgaattagtattagtgaaccattatcaagatgtatttattacaaaatctataataataaaaacaaaactgggaaagcaatgggaagaagatctgattggctttggaagacttcgcgtgttaataagatttttctcaaaaaagaaagatcggacggcaatgcgtggcaagtcgcttatgacgtcggaagcttagcttgccacgtgtacggtcatcaccatttaggtgaccgatataatgtatttcccgtgacttgacaatctaatctcccaatttatcgtgctccagtgtctcaagagagaacttactctattggttacccaaaactcacataaaacgtggattttatatttttttttatcaaataatttgatgtgcaatataaacatatatgtattattatcttgcatgtttaaaaaatgctaacttaaatttttcttcaatgattgagatttttcatacacatccatcgagttcacacttatgattaaacaaagtgtattgttacactaataacggttctaagttgtttcaatacgtttatgataacggttctatactaatactagtattcatacgtttatgaaactcgttaattatatatttaactttgtttagctgtatcataacaagcgttttaagaaataatttaataaaaaatgagaaaacgataagcgacgccttatcgcctatgtgtaattatcgtgtcaaaatatcgtgataaggaagctgtttcagaggagccttctcgtttgttgcgtcgttgctctgagccaacaacgctaatataaaaggaagctcaagtctctctgttttaatctcggaccaatatacaaaaccgtgtgttcttctctgtatcttattaaatcaaaaccaattttgttcttcttctttgattcttttttccttcattttttaacgtatcttgagagatcgac

SEQ ID NO: 396 - DNA, 482 bp, Arabidopsis thaliana
  misc_feature (1)..(482): Experimental sequence of Ceres PROMOTER  YP0258
taaataacttacttaaatttatattaaaaccgtttacatctgatataatttaaaaggttttagacgaattagtattagtgaaccattatcaagatgtatttattacaaaatctataataataaaaacaaaactgggaaagcaatgggaagaagatctgattggctttggaagacttcgcgtgttaataagatttttctcaaaaaagaaagatcggacggcaatgcgtggcaagtcgcttatgacgtcggaagcttagcttgccacgtgtacggtcatcaccatttaggtgaccgatataatgtatttcccgtgacttgacaatctaatctcccaatttatcgtgctccagtgtctcaagagagaacttactctattggttacccaaaactcacataaaacgtggattttatatttttttttatcaaataatttgatgtgcaatataaacatatatgtattattatcttgcatgtttaaaaaa

SEQ ID NO: 397 - DNA, 966 bp, Arabidopsis thaliana
  misc_feature: Encoded by SEQ ID NO: 396
  misc_feature (1)..(966): Ceres CDNA ID no. 12688873
  misc_feature (1)..(966): Sequence of endogenous gene to Ceres PROMOTER  YP0258
atgtcgtcgaagaaatccctagttcaaagtctcttcaacatttccaaaacctactccaggatttctggtcttacccgaatgcgtccgaccaaatccggcggcattcctcccgacgccggagattctggaatccgccgcagatttctccacaagagggcatttttctcgccggagatagttcctaaaggtggtaacttgatggagaaactcagggaattgactttgtccaataataatcgtattagactcgacgagatgttaccgccaccttcgccgaagaaatcatcaccggagtttttcccggcggtcacggtggaagacgtgaagaagctcatgagagcagcggaaatggagctggtgaaatcgaagctgagagagattggcaagaactgggttccttattcggagtttgttcgggtctgcggagaatacagttcggatcctgaacaaggtaaccgggtcgcgaatatgcttgacgaagctggaaacgtcatcgttttgggaaaactcgtctgccttaaacccgaagagctaacaagcgccatggctggtctgattccgacactcgaacccagtctcgacgccgagacaagacaagagttcgaacaacttgagatcataaaatcagatatcgacaaaagagccgatgatctggttcgaaaagaattatgggccggattaggcctaataatggcccaaacagttggattttttaggctgacgttttgggaactgtcgtgggacgtgatggaacccatatgcttctacgtaacttcgacatatttcatggctggttacgccttcttcctccgaacttcaaaggaaccttcctttgaaggtttttacaaaagccggttcgagacgaagcagaaacgtttgattaaaatgcttgatttcgatatcgatcgatttaccaagctacagaagatgcatcgtccaaatttgactaaatctggtcgttgttga

SEQ ID NO: 398 - protein, 321 aa, Arabidopsis thaliana
  misc_feature (1)..(321): Ceres CDNA ID no. 12688873
  misc_feature (1)..(321): Sequence of endogenous gene to Ceres PROMOTER  YP0258
MSSKKSLVQSLFNISKTYSRISGLTRMRPTKSGGIPPDAGDSGIRRRFLHKRAFFSPEIVPKGGNLMEKLRELTLSNNNRIRLDEMLPPPSPKKSSPEFFPAVTVEDVKKLMRAAEMELVKSKLREIGKNWVPYSEFVRVCGEYSSDPEQGNRVANMLDEAGNVIVLGKLVCLKPEELTSAMAGLIPTLEPSLDAETRQEFEQLEIIKSDIDKRADDLVRKELWAGLGLIMAQTVGFFRLTFWELSWDVMEPICFYVTSTYFMAGYAFFLRTSKEPSFEGFYKSRFETKQKRLIKMLDFDIDRFTKLQKMHRPNLTKSGRC

SEQ ID NO: 399 - DNA, 1019 bp, Arabidopsis thaliana
  misc_feature (1)..(1019): Predicted sequence of Ceres PROMOTER  YP0265
agtcgattggatactatcttatttcgtaactcaaaaagaaatatgattaatcgtcaaccatatcacctcgttacataaaagctagtggttttgctttttctaaaaaaccatcgtgttactatatcgtatctagtattttacaagatctatagtttaaatactgatattttctgaaaaacaaaaaaaattgaaatttgtatacttatatactatagaagaatgcagagaatagttattttcaaagagttgaggacaaaacttacggggacaaaaaagtggatcgaggagattccagtggtccaatattgattttggatagtggatatgaatatgcgcacgcaatagccaatacatctcaaaaagtcatttttttgtcaacatctcaaatgttttatgcaccaatattcaaatgaattctcgactctacgttgttagtggatacatctgcggttaattacaaatgtaacatacacgcataccatggaaatatatatatacacatatggaatttatggtataaccaccaccatgacatttgtaccattataccataaaaatcatgaaatcgtgtccaacaatatgatcattttagattggactatctacaattatatgtatgaaacgtacgtggtactcgatgagtacgtacatggtttaaagcttacacgggatgggaattttgaaaaagctatgatgggctcttaaattcgttgaaagcttacaatagatgaaacaaagaaaacctgcatacatcaagtacgtactataattacactaaggaatgaaaagaaatcatcaaggctttcatgaagtatccgtatcaataatttgtttaggttacagaaattgactacaactaatttttatttttacggttccatgcaaattaatccattttaaacaaatcctccattgttttgtataatgttggagattagtaggattagtcggataatatggcataaacataatatgatgctaaattctaaagaaacgatatgaataaataccattgcact

SEQ ID NO: 400 - DNA, 657 bp, Arabidopsis thaliana
  misc_feature (1)..(657): Experimental sequence of Ceres PROMOTER YP0265
gtcgattggttttttttttacggtttcctgcaaattaatccattttaaacaaatcctccattgttttgtataatgttggagattagtaggattagtcggataatatggcataaacataatatgatgctaaattctaaagaaacgatatgaataaataatgcagcagtataaaaactgtaccattgcgtgggtggaggattttaggtcattgttagggcactttcatggggaccatttccgccttaacgaagacttattacacacaaccgtcaatgtgggctggaaacttgcagtgcaatccggtctggtcctataatttatggccggttagggtttacaagtttttaatctatcaattaaatgagatggacacaaaatgtaatcaccagtggaaaagaaaacattacgagacttatacaatgtctacaagaagactcgagtggggcaacatgttgtacataatccgacgtcgttttgggagtcagtaaataaagttcgagaaatgacgtcgttttgaagtcatccgagagaaaatgacttaaagtgaccgacgttgttttgaagtcagcggaagagtaaagaagtaagaaacgaagtcgttttgaagtcatctcttcagatatgtttgttctaattaaaatttcccaagtgggaatt

SEQ ID NO: 401 - DNA, 2085 bp, Arabidopsis thaliana
  misc_feature: Encoded by SEQ ID NO: 400
  misc_feature (1)..(2085): Ceres CDNA ID no. 13604752
  misc_feature (1)..(2085): Sequence of endogenous gene to Ceres PROMOTER  YP0265
aggagtaaagaagtaagaaacgaagccgttttgaagtcatctcttcagatatgtttgttctaattaaaatttccaagtgggaattagtttgtaattgaaggtatgcacgatttttagttacaattttaattcttcttcttcagatccaagaactctcagtctctgcgttcacactctttctttgaatccttcatcatcctaattcatctccaagaactgaatcagaagttgtatttcgctaattcaacttttccagtgtctgtcaattaggttttgattttggaagtagagaagttagaagaagaatggtgagaacgccgcgaagagggcagagatcaaagggaattaaagtgaagcattgtattcagttgactctattgcttggtgttgggatatggctgatttatcaaatgaagcattcacatgagaagaaagctgagtttgaagggacttcaaagattgttgttgatgatattgataatacagttgttaatcttggaaggaaagatcttagaccgcgtattgaggagacgaaagatgtgaaggacgaagtggaagatgaagaagggagcaagaatgaaggaggaggagacgtaagtactgataaggagaatggtgatgagattgtagagagggaggaggaggaaaaggctgtagaagagaataacgagaaggaagctgaaggtaccgggaatgaagagggaaacgaggattcaaacaatggagaaagtgagaaggttgttgatgagagtgaaggtggaaatgagataagtaatgaggaagctagggagatcaattacaagggagatgatgcgtcgagtgaggttatgcatgggacggaggagaagagcaatgaaaaggttgaagttgagggagaaagtaaatctaatagtactgaaaatgtcagtgtccatgaagatgagtcgggtccaaagaatgaagtattggagggttctgttattaaagaagtttctttgaacacaactgagaatggtagtgatgatggtgagcaacaagagacaaagagtgagttggattcaaagactggtgagaagggcttttctgattctaatggtgaattgcctgagactaacctgtcaacttccaatgcaactgaaactacagaatcttctgggagtgatgagtcaggatcgagcgggaaatccactggttatcaacaaacgaaaaacgaagaagatgagaaggaaaaggtacaatcatctgaagaggaaagcaaagtcaaagaatccgggaaaaatgagaaggacgcgtcctcgtcccaagacgaaagtaaagaggaaaaacccgagagaaagaagaaagaagagtcttcgtcccaaggggaaggtaaagaagaagaacccgagaaaagggagaaagaagactcttcatcccaagaggaaagtaaagaggaagaacctgagaacaaagagaaagaagcgtcttcctctcaggaggagaatgagattaaagaaactgagataaaggagaaagaagagtcttcgtcccaagaggggaatgagaacaaagaaacagaaaaaaagtcttccgaatctcagagaaaggaaaacaccaacagtgagaagaaaattgaacaggtggaatctactgattcttcaaacacacagaagggtgacgaacagaaaactgatgaaagcaagagagaatccggcaatgatacttcaaataaggaaacagaggatgatagttcaaaaacagagtcagagaagaaagaggaaaataacagaaatggtgaaacagaggagacccaaaacgaacaagaacagaccaagtccgctttggaaattagtcacactcaagatgttaaggatgctcgaactgatctagaaactcttcctgaaaccagcaatggattgatcagcgacaaagttgctgctgagtgatacttgttaaatgtgtgaagctgtcatgtattgtatgcatattctatacttctcaccaaatgacgggacttaagtcccaatcaaagtagtattgagtttttaatcgtaatcagtacatgtgtatgtatacttttatatctaattctctctgagtctctaataatgaagaagtttttttttt

SEQ ID NO: 402 - protein, 532 aa, Arabidopsis thaliana
  misc_feature (1)..(532): Ceres CDNA ID no. 13604752
  misc_feature (1)..(532): Sequence of endogenous gene to Ceres PROMOTER  YP0265
MVRTPRRGQRSKGIKVKHCIQLTLLLGVGIWLIYQMKHSHEKKAEFEGTSKIVVDDIDNTVVNLGRKDLRPRIEETKDVKDEVEDEEGSKNEGGGDVSTDKENGDEIVEREEEEKAVEENNEKEAEGTGNEEGNEDSNNGESEKVVDESEGGNEISNEEAREINYKGDDASSEVMHGTEEKSNEKVEVEGESKSNSTENVSVHEDESGPKNEVLEGSVIKEVSLNTTENGSDDGEQQETKSELDSKTGEKGFSDSNGELPETNLSTSNATETTESSGSDESGSSGKSTGYQQTKNEEDEKEKVQSSEEESKVKESGKNEKDASSSQDESKEEKPERKKKEESSSQGEGKEEEPEKREKEDSSSQEESKEEEPENKEKEASSSQEENEIKETEIKEKEESSSQEGNENKETEKKSSESQRKENTNSEKKIEQVESTDSSNTQKGDEQKTDESKRESGNDTSNKETEDDSSKTESEKKEENNRNGETEETQNEQEQTKSALEISHTQDVKDARTDLETLPETSNGLISDKVAAE

SEQ ID NO: 403 - DNA, 1014 bp, Arabidopsis thaliana
  misc_feature (1)..(1014): Predicted sequence of Ceres PROMOTER  YP0276
agtcgattgggttactatataaggtaatgaaacattttgagttgatattatacgcgactaacagattctctatgaaaataacaagaagtgcgataagtggagtggccactataaaaaatagttcctaagagtgtgtttaattagcaaatgactgaaagcaattaaaaaacaaaaattgtttactatgttgtgattgataatgagcacctagctaccatagacgtgttttacagagaaacaaaactaggtgaaaattgaaagagtgaaattgaagttgaaccgatccggttagacaactagaatcgtagtagcctagtaggtgtcggccaccgtaattgaaacaaaaagcttattaattaacaaaattaccatcatttgtttttactgtcaaaattcaaattaccatcgtctaacctgtttttgttaacaagtactaattgttgtcttcattagctaagtcataaattctaaaggttagcgtgctattttgatcatttgtgcgataatattatatatcaaaaataatcgtaaccatgtaatcgtacagttaaaaaaagtgctcttgaatcacgaagaaatctttttataatcactcgaatcgtattccttaacacatatggcaaacccttgaaatctttcttcttttatactagtacgacaaaataaaataaaaattatggtgtctttaagaaaaacttgtaaattatcataataaactatgaaaattcatattcgtgatttttttttttttttgcttttcgtcacaaatcatttttttttttttttggttttttgctgaaatatttacgatcattgccctcagactactatactacgagaccgcctcaacttggccagtctatctatttccattgtctctatctctctctctctttgaagcagtttgttacttcttacttttgtgtttcttcatattcttcagaagcaagcacaaggctagggatcgaagaagcggcgatcactgatcgtatctcactacgccattgcactgga

SEQ ID NO: 404 - DNA, 991 bp, Arabidopsis thaliana
  misc_feature (1)..(991): Experimental sequence of Ceres PROMOTER  YP0276
gttactatataaggtaatgaaacattttgagttgatattatacgcgactaacagattctctatgaaaataacaagaagtgcgataagtggagtggccactataaaaaatagttcctaagagtgtgtttaattagcaaatgactgaaagcaattaaaaaacaaaaattgtttactatgttgtgattgataatgagcacctagctaccatagacgtgttttacagagaaacaaaactaggtgaaaattgaaagagtgaaattgaagttgaaccgatccggttagacaactagaatcgtagtagcctagtaggtgtcggccaccgtaattgaaacaaaaagcttattaattaacaaaattaccatcatttgtttttactgtcaaaattcaaattaccatcgtctaacctgtttttgttaacaagtactaattgttgtcttcattagctaagtcataaattctaaaggttagcgtgctattttgatcatttgtgcgataatattatatatcaaaaataatcgtaaccatgtaatcgtacagttaaaaaaagtgctcttgaatcacgaagaaatctttttataatcactcgaatcgtattccttaacacatatggcaaacccttgaaatctttcttcttttatactagtacgacaaaataaaataaaaattatggtgtctttaagaaaaacttgtaaattatcataataaactatgaaaattcatattcgtgatttttttttttttttgcttttcgtcacaaatcatttttttttttttttggttttttgctgaaatatttacgatcattgccctcagactactatactacgagaccgcctcaacttggccagtctatctatttccattgtctctatctctctctctctttgaagcagtttgttacttcttacttttgtgtttcttcatattcttcagaagcaagcacaaggctagggatcgaagaagcggcgatcactgatcgtatctcactacg

SEQ ID NO: 405 - DNA, 1278 bp, Arabidopsis thaliana
  misc_feature: Encoded by SEQ ID NO: 404
  misc_feature (1)..(1278): Ceres CDNA ID no. 13617271
  misc_feature (1)..(1278): Sequence of endogenous gene to Ceres PROMOTER  YP0276
cacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatatctctggctgaagaaacaggtttggatcaaaaacaaatcaacaattggtttataaaccaaaggaaacgccattggaagccttcggagaacatgccgtttgatatgatggacgattctaatgaaacattctttaccgagtaatgaaaagagagacatgaaattgtgcattgtataatttttacactgtttttccaagaaaagaaaacagtaaaaagcttttggtaaatggggcatcatcgcgaatgaatggaacccgttagccaaaacggtcaagggcgtaacgagacattgtattggaaatagtggcaatattatgtcactaatcttccaatcatccaaattgatagatttcttatttgtattgaaccttacttagatagctgatgtgtcaactaaataatttattttcattatccattcgggtag

SEQ ID NO: 406 - protein, 310 aa, Arabidopsis thaliana
  misc_feature (1)..(310): Ceres CDNA ID no. 13617271
  misc_feature (1)..(310): Sequence of endogenous gene to Ceres PROMOTER  YP0276
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKISLAEETGLDQKQINNWFINQRKRHWKPSENMPFDMMDDSNETFFTE

SEQ ID NO: 407 - DNA, 1011 bp, Arabidopsis thaliana
  misc_feature (1)..(1011): Predicted sequence of Ceres PROMOTER  YP0172
agtcgattgggcagtcgattggatgaaaacaatgggagaagtacatgcttgtcctcacacactaatgccgatgaggaaagcctttaaggggacttttatctccgcaggaggtttcacgagggaagatgggaatgaggctgtgtcaaagggaagaactgatttggtggcttatggtcgatggtttctagccaacccggacctgccaaagaggttccaagtggatgcaccgctgaataagtacgatagaccaacgttttacacttctgatccagtcgtcggttacaccgattaccctttcctcgaatcaacagcttaaaattgtttcaataatgtaatgtagtgtgtttcccttatataagatgtaataagtttctggcttttcatttatactttttaagtttaagtcataaaaccttcacaaaaatttccacggacacattatcacaaaagcgctttctagagaccaacataacttaacttgattgttgatttctgtttgatgtgatcatgccgcaatccagtgtgttctcatgatgctatcttccctcctttcacatgctgcacagaacaaaacagagcattttcctcccaactatacctaattttttttggtcggtggtcaaagttatacatcggaagaatctgttgaaatcatattgaggcccctcatttgttatgttatgtaatctccaatggatcaaaagtagaatcccaactgtagaagatgatactatcatgctaggtagaagacagcatggaatatggggtaagttcaaagtggttacactctaatgtcgtctcaacgaatacgtctttatgaagaaataaaaaaatctaagtggttggatgcgtcatcaatgacgaccacgtcgttaaagacagaaagaaacacttgcgttcctgattctctgatcaatcaatgtgtataaatatgttcggatatgtccattatcttacgcaatcttgaaaagtgtttttgagagaaatataggttttacaaaccattgcact

SEQ ID NO: 408 - DNA, 1011 bp, Arabidopsis thaliana
  misc_feature (1)..(1011): Experimental sequence of Ceres PROMOTER  YP0172
gcagtcgattggatgaaaacaatgggagaagtacatgcttgtcctcacacactaatgccgatgaggaaagcgtttaaggggacttttatctccgcaggaggtttcacgagggaagatgggaatgaggctgtgtcaaagggaagaactgatttggtggcttatggtcgatggtttctagccaacccggacctgccaaagaggttccaagtggatgcaccgctgaataagtacgatagaccaacgttttacacttctgatccagtcgtcggttacaccgattaccctttcctcgaatcaacagcttaaaattgttatcaataatgtaatgtagtgtgtttcccttatataagatgtaataagtttctggcttttcatttatactttttaagtttaagtcataaaaccttcacaaaaatttccacggacacattatcacaaaagcgctttctagagaccaacataacttaacttgattgttgatttctgtttgatgtgatcatgccgcaatccagtgtgttctcatgatgctatcttccctcctttcacatgctgcacagaacaaaacagagcattttcctcccaactatacctaattttttttggtcggtggtcaaagttatacatcggaagaatctgttgaaatcatattgaggcccctcatttgttatgttatgtaatctccaatggatcaaaagtagaatcccaactgtagaagatgatactatcatgctaggtagaagacagcatggaatatggggtaagttcaaagtggttacactctaatgtcgtctcaacgaatacgtctttatgaagaaataaaaaaatctaagtggttggatgcgtcatcaatgacgaccacgtcgttaaagacagaaagaaacacttgcgttcctgattctctgatcaatcaatgtgtataaatatgttcggatatgtccattatcttacgcaatcttgaaaagtgtttttgagagaaatataggttttacaaaatccaccgttgtgaattca

SEQ ID NO: 409 - DNA, 1313 bp, Arabidopsis thaliana; identical to SEQ ID NO: 391
  misc_feature: Encoded by SEQ ID NO: 408
  misc_feature (1)..(1313): Ceres CDNA ID no. 13619728
  misc_feature (1)..(1313): Sequence of endogenous gene to Ceres PROMOTER  YP0172

SEQ ID NO: 410 - protein, 374 aa, Arabidopsis thaliana; identical to SEQ ID NO: 392
  misc_feature (1)..(374): Ceres CDNA ID no. 13619728
  misc_feature (1)..(374): Sequence of endogenous gene to Ceres PROMOTER  YP0172

SEQ ID NO: 411 - DNA, 1000 bp, Arabidopsis thaliana
  misc_feature (1)..(1000): Predicted sequence of Ceres PROMOTER  YP0094
taaagatcagaagaggaaggtttcgccgcggcggttgcatcttcaccgtcgatttcatcgttacagcgacgccggtaattcctaggttgcttagttcccattctctctctaaaattagggctcgaaatgaattgttgaacaagatagagatctttttctgatccccgtcgaacatttattcaaggccaaaaaaagcacacgggaatttagagtaccaatacatatcaaaacctaatgggctttgaatggttgcatgtgtgtgtttatttctgatatgcaaagcgatcgatagtcttttccatacaagtgtaaactgtaaacaacgtaattaagcataacaatacaactctttcttctctttttttttgtaaacacaaaataaaattacatcaattcatgcttttcctagttcatctgacattttccaaaattcatgttccattgagtccctaatacttgttcatattcatattagggtacatgaataaaagttatcattcttgaaactactaaattttcatagtttatttttcttcttttcgtttcactttcgaacaaaacactacgcgtggcatttgcaatgaattccacattatatggaataacaccatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgc

SEQ ID NO: 412 - DNA, 438 bp, Arabidopsis thaliana
  misc_feature (1)..(438): Experimental sequence of Ceres PROMOTER  YP0094
taaagatcagaagaggaaggtttcgccgcggcggttgcatcttcaccgtcgatttcatcgttacagcgacgccggtaattcctaggttgcttagttcccattctctctctaaaattagggctcgaaatgaattgttgaacaagatagagatctttttctgatccccgtcgaacatttattcaaggccaaaaaaagcacacgggaatttagagtaccaatacatatcaaaacctaatgggctttgaatggttgcatgtgtgtgtttatttctgatatgcaaagcgatcgatagtcttttccatacaagtgtaaactgtaaacaacgtaattaagcataacaatacaactctttcttctctttttttttgtaaacacaaaataaaattacatcaattcatgcttttcctagttcatctgacattttccaaaattcatgtt

SEQ ID NO: 413 - DNA, 1761 bp, Arabidopsis thaliana
  misc_feature: Encoded by SEQ ID NO: 412
  misc_feature (1)..(1761): Ceres CDNA ID no. 13609817
  misc_feature (1)..(1761): Sequence of endogenous gene to Ceres PROMOTER  YP0094
gcagcagcaaatactatcatcacccatctccttagttctattttataattcctcttctttttgttcatagctttgtaattatagtcttatttctctttaaggctcaataagaggagatgggtgaaaccgctgccgccaataaccaccgtcaccaccaccatcacggccaccaggtctttgacgtggccagccacgatttcgtccctccacaaccggcttttaaatgcttcgatgatgatggccgcctcaaaagaactgggactgtttggaccgcgagcgctcatataataactgcggttatcggatccggcgttttgtcattggcgtgggcgattgcacagctcggatggatcgctggccctgctgtgatgctattgttctctcttgttactctttactcctccacacttcttagcgactgctacagaaccggcgatgcagtgtctggcaagagaaactacacttacatggatgccgttcgatcaattctcggtgggttcaagttcaagatttgtgggttgattcaatacttgaatctctttggtatcgcaattggatacacgatagcagcttccataagcatgatggcgatcaagagatccaactgcttccacaagagtggaggaaaagacccatgtcacatgtccagtaatccttacatgatcgtatttggtgtggcagagatcttgctctctcaggttcctgatttcgatcagatttggtggatctccattgttgcagctgttatgtccttcacttactctgccattggtctagctcttggaatcgttcaagttgcagcgaatggagttttcaaaggaagtctcactggaataagcatcggaacagtgactcaaacacagaagatatggagaaccttccaagcacttggagacattgcctttgcgtactcatactctgttgtcctaatcgagattcaggatactgtaagatccccaccggcggaatcgaaaacgatgaagaaagcaacaaaaatcagtattgccgtcacaactatcttctacatgctatgtggctcaatgggttatgccgcttttggagatgcagcaccgggaaacctcctcaccggttttggattctacaacccgttttggctccttgacatagctaacgccgccattgttgtccacctcgttggagcttaccaagtctttgctcagcccatctttgcctttattgaaaaatcagtcgcagagagatatccagacaatgacttcctcagcaaggaatttgaaatcagaatccccggatttaagtctccttacaaagtaaacgttttcaggatggtttacaggagtggctttgtcgttacaaccaccgtgatatcgatgctgatgccgttttttaacgacgtggtcgggatcttaggggcgttagggttttggcccttgacggtttattttccggtggagatgtatattaagcagaggaaggttgagaaatggagcacgagatgggtgtgtttacagatgcttagtgttgcttgtcttgtgatctcggtggtcgccggggttggatcaatcgccggagtgatgcttgatcttaaggtctataagccattcaagtctacatattgatgattatggaccatgaacaacagagagagttggtgtgtaaagtttaccatttcaaagaaaactccaaaaatgtgtatattgtatgttgttctcatttcgtatggtctcatctttgtaataaaatttaaaacttatgttataaattataaaaccgtgtgttttc

SEQ ID NO: 414 - protein, 493 aa, Arabidopsis thaliana
  misc_feature (1)..(493): Ceres CDNA ID no. 13609817
  misc_feature (1)..(493): Sequence of endogenous gene to Ceres PROMOTER  YP0094
MGETAAANNHRHHHHHGHQVFDVASHDFVPPQPAFKCFDDDGRLKRTGTVWTASAHIITAVIGSGVLSLAWAIAQLGWIAGPAVMLLFSLVTLYSSTLLSDCYRTGDAVSGKRNYTYMDAVRSILGGFKFKICGLIQYLNLFGIAIGYTIAASISMMAIKRSNCFHKSGGKDPCHMSSNPYMIVFGVAEILLSQVPDFDQIWWISIVAAVMSFTYSAIGLALGIVQVAANGVFKGSLTGISIGTVTQTQKIWRTFQALGDIAFAYSYSVVLIEIQDTVRSPPAESKTMKKATKISIAVTTIFYMLCGSMGYAAFGDAAPGNLLTGFGFYNPFWLLDIANAAIVVHLVGAYQVFAQPIFAFIEKSVAERYPDNDFLSKEFEIRIPGFKSPYKVNVFRMVYRSGFVVTTTVISMLMPFFNDVVGILGALGFWPLTVYFPVEMYIKQRKVEKWSTRWVCLQMLSVACLVISVVAGVGSIAGVMLDLKVYKPFKSTY

SEQ ID NO: 415 - DNA, 999 bp, Arabidopsis thaliana
  misc_feature (1)..(999): Predicted sequence of Ceres PROMOTER  YP0259
taaatagtgacattggtaagaagaaaaaaacactattaaatagtgaaaaaatgtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttatccttttttctttaataatatgcaattgtgagagtttggatttgaatggtagcattagaagcaaacttgaaccaaacatatttcatgaagtcaaacttgaaccaatgtaatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacaccgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcatccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgagga

SEQ ID NO: 416 - DNA, 1002 bp, Arabidopsis thaliana
  misc_feature (1)..(1002): Experimental sequence of Ceres PROMOTER  YP0259
taaatagtgacattggtaagaagaaaaaaaacactattaaatagtgaaaaaatggtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttattcttttttctttaataatatgcaattgtgagagtttggatttgaatggtagcattagaagcaaacttgaaccaaacatatttcatgaagtcaaacttgaaccaatgtgatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacagcgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcagccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggac

SEQ ID NO: 417 - DNA, 1785 bp, Arabidopsis thaliana
  misc_feature: Encoded by SEQ ID NO: 416
  misc_feature (1)..(1785): Ceres CDNA ID no. 12728113
  misc_feature (1)..(1785): Sequence of endogenous gene to Ceres PROMOTER  YP0259
atgagtgactcggtgtcgatctcggttccgtataggaatttgaggaaggaaattgaacttgagacggtcaccaagcatcgtcaaaacgaatctggttcttcgtcgttctctgaatctgcttctccttcgaatcattctgattcggctgatggtgaatctgtgtcgaagaattgtagtttagtgacgttggttcttagttgtacagttgccgctggagttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggctaa

SEQ ID NO: 418 - protein, 594 aa, Arabidopsis thaliana
  misc_feature (1)..(594): Ceres CDNA ID no. 12728113
  misc_feature (1)..(594): Sequence of endogenous gene to Ceres PROMOTER  YP0259
MSDSVSISVPYRNLRKEIELETVTKHRQNESGSSSFSESASPSNHSDSADGESVSKNCSLVTLVLSCTVAAGVQFGWALQLSLLTPYIQTLGISHAFSSFIWLCGPITGLVVQPFVGIWSDKCTSKYGRRRPFILVGSFMISIAVIIIGFSADIGYLLGDSKEHCSTFKGTRTRAAVVFIIGFWLLDLANNTVQGPARALLADLSGPDQRNTANAVFCLWMAIGNILGFSAGASGKWQEWFPFLTSRACCAACGNLKAAFLLAVVFLTICTLVTIYFAKEIPFTSNKPTRIQDSAPLLDDLQSKGLEHSKLNNGTANGIKYERVERDTDEQFGNSENEHQDETYVDGPGSVLVNLLTSLRHLPPAMHSVLIVMALTWLSWFPFFLFDTDWMGREVYHGDPTGDSLHMELYDQGVREGALGLLLNSVVLGISSFLIEPMCQRMGARVVWALSNFTVFACMAGTAVISLMSLSDDKNGIEYIMRGNETTRTAAVIVFALLGFPLAITYSVPFSVTAEVTADSGGGQGLAIGVLNLAIVIPQMIVSLGAGPWDQLFGGGNLPAFVLASVAAFAAGVIALQRLPTLSSSFKSTGFHIG

SEQ ID NO: 419 - DNA, 1019 bp, Arabidopsis thaliana
  misc_feature (1)..(1019): Predicted sequence of Ceres PROMOTER  YP0211
agtcgattggttatggttttgtataaaaacccatttgattgtaatttttatttaagttttggtttaggtttggtttgattaaaaaccgtaaaaccgaacgttttttttgtttttgatttaaattaaaaataattgtatatatatatatataatgttcatttgataacatgatatctatcaaactatcgaaaaacaaaaccctaactgtaacctaaactaaaattctatataaattacatgccgtcatttaggatttgagtttacaaattagattttgattttatttatgcatcacacttataattttttttggtaaaaacatgaaaaaaccggaaccaaaccggaaccgatccgaaccaaaatacatatggtttttaaatggttttaattttttaaaaccaaaaactgtaaaactgttaaaaccgaaccgtaaccaaaccgaattttatatggtttttatatggttttacttttcttaaaatcgaaaaaccgtaaaacctaaaaccgaaacgaaaccaaaccgaaaaactgaacacccagcccttaaatataatgaaaatcgaataaatttgtttgaaagaatcgaacaaaattgacaataaaatctaattaggactattttcgtctaattttgacttagttgaaacagaatattagcaaaaatactaaaacaccacaacgcgtaataatacccacacacgatatcattaaatttgaccaataagaatctagctcttggcgaccacgcaagtatcttccatcttgctctccaagaaaaatctacaccggctttaaatttacataaacaccctcagtcaaagaaaagtcgtaaacatagtctctctcatgaccacaagggtaacacagtcatcctaaatataaaccacacaagaaaactgttatactttatacacgtgtcatagtctcattacatctacgtgaagagtttcgatcatcaaccgttcgttttcttactatataaaccttgctcgagacctgcgtgtgaagcccattgcact

SEQ ID NO: 420 - DNA, 1002 bp, Arabidopsis thaliana; identical to SEQ ID NO: 416
  misc_feature (1)..(1002): Experimental sequence of Ceres PROMOTER  YP0211

SEQ ID NO: 421 - DNA, 1342 bp, Arabidopsis thaliana
  misc_feature: Encoded by SEQ ID NO: 420
  misc_feature (1)..(1342): Ceres CDNA ID no. 13603177
  misc_feature (1)..(1342): Sequence of endogenous gene to Ceres PROMOTER  YP0211
gtataaagacgacaaagtaaaccaaaaaaaaaaagagttctcctacaattttcctaaattcttggatttgagatttcactttttccgatttgaaacaatgatgataactcgcggtggagccaaggcggcgaaatcgctgttagtggcggctggaccacgtttgttctcgacggtccgtacggtttcgtctcacgaggctttatcagcaagccatattttgaagcctggtgttacatctgcttggatatggactagagctccgacgattggaggtatgagattcgctagcacgatcactctgggagagaaaactccgatgaaggaggaggacgcgaatcagaagaaaacagagaacgaatccaccggtggagacgccgccggaggtaataacaagggagataaaggaatcgcgagctattggggtgttgaacctaataagattactaaagaagatggttctgaatggaagtggaactgtttcaggccatgggaaacgtataaagctgatataacgatagatctgaagaagcatcatgttccaacgacgtttcttgatagaatagcttattggactgttaaatctcttcgttggcctaccgatttgttcttccagaggagatatggatgtcgagctatgatgcttgaaactgtagcagcagtacctggaatggttggaggaatgttactacactgcaaatcgcttcgacgttttgagcaaagtggaggatggattaaggctcttcttgaggaagcagagaatgagagaatgcatcttatgacattcatggaagtcgcgaaaccgaaatggtacgagagagcgctcgtgatcactgtgcaaggagtcttcttcaacgcttatttccttggttacttaatctctcccaagtttgctcatcgtatggttgggtaccttgaagaagaagcgatccattcttatactgagtttctcaaggaacttgacaaaggtaacattgagaatgttcctgctccggctattgctattgattactggaggcttcctgctgatgcgacacttcgtgatgttgtgatggttgttcgtgctgacgaggctcatcaccgtgatgtaaaccattttgcatctgatattcactaccaaggtcgtgaactaaaggaagctccagctccaattgggtatcattgattcgattaaaagaagagctttttctcaagtttaaaactttgttctaaagaatttaagttctttgacttgtatatacatcatcacctctgcttaagccatacttggattcggctttctttgaatgttgctacgaatgttctgatttcttctttacttttcctgtcaatgggcttttgggct

SEQ ID NO: 422 - protein, 354 aa, Arabidopsis thaliana
  misc_feature (1)..(354): Ceres CDNA ID no. 13603177
  misc_feature (1)..(354): Sequence of endogenous gene to Ceres PROMOTER  YP0211
MMITRGGAKAAKSLLVAAGPRLFSTVRTVSSHEALSASHILKPGVTSAWIWTRAPTIGGMRFASTITLGEKTPMKEEDANQKKTENESTGGDAAGGNNKGDKGIASYWGVEPNKITKEDGSEWKWNCFRPWETYKADITIDLKKHHVPTTFLDRIAYWTVKSLRWPTDLFFQRRYGCRAMMLETVAAVPGMVGGMLLHCKSLRRFEQSGGWIKALLEEAENERMHLMTFMEVAKPKWYERALVITVQGVFFNAYFLGYLISPKFAHRMVGYLEEEAIHSYTEFLKELDKGNIENVPAPAIAIDYWRLPADATLRDVVMVVRADEAHHRDVNHFASDIHYQGRELKEAPAPIGYH

SEQ ID NO: 423 - DNA, 1144 bp, Arabidopsis thaliana
  misc_feature (1)..(1144): Predicted sequence of Ceres PROMOTER  YP0190
agtcgattgggattgttggggcatgtgtgatgcgtttaacgattctaacagtatatgaaattatattttttggtcttgttatttgtctaaaaacctatatttttctcgtaagaatattgtaagagttatttttcgaaaatttaaataatgattcgatcaacactttttctcattttatcaaacccctttgattgaatagaccgctaaaacaatttgcttgattggtctttcttacaacgactaagttacaaatgtgactgaaagttaccgatcaaacccatgaaaaaaacttgagcccatataccttgctatggatttggcacacagaccaagctttcgaagcaactgtttggttgattcggaattgttttctgataataaataatatttatattattcgttatgtgtttgtgataggataactcggaacataagcaactttaacttgtggcgatgcgagaaccaatgtgaaataggcatgtgagagaccacattgtcccacagcttttgtcctcttcacccccgcaattatattaccattaattaatcacatagttatcgttttccaaatcgtaatatacatatcgtagttgttcatctttaatctattttcggtaatctaacaaaaagaaagatatctcgtagtgaaaatacgaatatcagtgctttttatgcaacaattatgacattaggtatcgttactcaaagttaaatgaatacaatctagacgacgcttaaaaaacgaatagatgatggaatcacgacttaacactagaattaccatggaatataggcaatttgcgaatttattcaaccaaaccaaaaatcgacagtgttatttagtcaaaccttctaagaaaaagtgacccatttccaaggaacgatgaataaaaaaaccggaccaatgttgttccgacataagtcactagtggcaaagtcataatttagacaaaggaaaggggcctttcttgcacaattttgcatataagagctctctctcctcctcgttccattgcactggtctattccactcccactaaacattccttctctcgctcactcttctccaatccttattttattttttgaaagtttaaaattttatacaacatatcaatttggggtagaaaaattcgaaagaaaa

SEQ ID NO: 424 - DNA, 1002 bp, Arabidopsis thaliana; identical to SEQ ID NO: 416
  misc_feature (1)..(1002): Experimental sequence of Ceres PROMOTER  YP0190

SEQ ID NO: 425 - DNA, 1418 bp, Arabidopsis thaliana
  misc_feature: Encoded by SEQ ID NO: 424
  misc_feature (1)..(1418): Ceres CDNA ID no. 12371508
  misc_feature (1)..(1418): Sequence of endogenous gene to Ceres PROMOTER  YP0190
attccactcccactaaacattccttctctcgctcactcttctccaatccttattttattttttgaaagtttaaaattttatacaacatatcaatttggggtagaaaaattcgaaagaaatgaaagagatgggagtgatagtgcttcttctccttcactcgttcttctacgttgccttttgcttcaatgatggactactaccaaacggtgacttcgaactcggtccacgacattcggacatgaaaggaacacaagttatcaacataacagcaatcccaaactgggaactctcaggctttgtcgagtacattccctcaggacacaaacaaggcgacatgatccttgtcgtgcctaaaggcgcattcgcagtacgtctaggcaacgaagcctcaatcaaacaaaaaatcagcgttaagaaagggtcgtactattcgataacgttcagtgctgctcgaacatgcgcacaagacgagcggttaaacgtttccgtggctcctcaccatgcagtgatgccgatacaaacagtgtatagtagctcaggttgggatttgtattcgtgggcttttaaggcccaaagtgactatgcagatatagtgatacataatccaggtgttgaggaagatcctgcttgtggacctctcattgatggtgttgctatgcgagcccttttccctcctcgtcccaccaataagaacattctaaagaacggaggattcgaagaaggtccttgggttttaccaaacatatcatctggtgttttgattccaccaaactccatcgacgatcactctccgttacctggttggatggtcgagtctcttaaagctgtcaaatacatagattccgatcatttctccgttcctcaaggccgtcgcgccgtcgaactcgtcgccgggaaagaaagcgccgtcgcacaagttgtccgcactatccctggaaaaacctacgtcctatccttctctgtcggagatgctagcaacgcttgcgccggatcaatgatcgtcgaagctttcgccggaaaagacacgatcaaggtcccgtatgaatcgaaagggaaaggaggattcaagcgatcgtcattgagattcgtcgctgtctcgagtcggactagagttatgttctacagtacgttttacgcgatgagaaacgacgatttctcgagcttatgtggaccggtgatcgacgacgttaagcttctcagtgctcggaggccgtgagcttgcggcgacgagttgattcacgggacaatgaatgatgacagtcactgtgggtttctcgcgtctagtgagaaattgggcttttaggcccagtggcccactgtttttgttgttgttttaaagcttaatgttatttgacaaagaaaaaagaaattactctggtcaatcatatcgaaccgtgaaattttatgatcttgtgatt

SEQ ID NO: 426 - protein, 365 aa, Arabidopsis thaliana
  misc_feature (1)..(365): Ceres CDNA ID no. 12371508
  misc_feature (1)..(365): Sequence of endogenous gene to Ceres PROMOTER  YP0190
MKEMGVIVLLLLHSFFYVAFCFNDGLLPNGDFELGPRHSDMKGTQVINITAIPNWELSGFVEYIPSGHKQGDMILVVPKGAFAVRLGNEASIKQKISVKKGSYYSITFSAARTCAQDERLNVSVAPHHAVMPIQTVYSSSGWDLYSWAFKAQSDYADIVIHNPGVEEDPACGPLIDGVAMRALFPPRPTNKNILKNGGFEEGPWVLPNISSGVLIPPNSIDDHSPLPGWMVESLKAVKYIDSDHFSVPQGRRAVELVAGKESAVAQVVRTIPGKTYVLSFSVGDASNACAGSMIVEAFAGKDTIKVPYESKGKGGFKRSSLRFVAVSSRTRVMFYSTFYAMRNDDFSSLCGPVIDDVKLLSARRP

SEQ ID NO: 427 - DNA, 1005 bp, Arabidopsis thaliana
  misc_feature (1)..(1005): Predicted sequence of Ceres PROMOTER  YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatggggcagtccattgcact

SEQ ID NO: 428 - DNA, 995 bp, Arabidopsis thaliana
  misc_feature (1)..(995): Experimental sequence of Ceres PROMOTER  YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatgtggcagt

SEQ ID NO: 429 - DNA, 1846 bp, Arabidopsis thaliana
  misc_feature: Encoded by SEQ ID NO: 428
  misc_feature (1)..(1846): Ceres CDNA ID no. 12683820
  misc_feature (1)..(1846): Sequence of endogenous gene to Ceres PROMOTER  YP0212
acacaaccaaagcgtttagaaaaaaacagcgataaaaccgaaacatcaagcaaacaaaaaaaaaagagaagagaaattatttttttttgttttcgttttcaaaaacaaaatctttgaattttatggcaacccgtcttctccgaacaaactttatccggcgatcttaccgtttacccgcttttagcccggtgggtcctcccaccgtgactgcttccaccgccgtcgtcccggagattctctcctttggacaacaagcaccggaaccacctcttcaccacccaaaacccaccgagcaatctcacgatggtctcgatctctccgatcaagcccgtcttttctcctctatcccaacctctgatctcctccgttccaccgccgtgttgcatgcggcggcgataggtcctatggtcgacctagggacgtgggtcatgagctctaaacttatggacgcttcggtgacgcgtggcatggttttagggcttgtgaaaagtacgttttatgaccatttttgcgccggtgaagatgccgacgcagccgctgagcgcgtgagaagcgtttatgaagctactggtcttaaagggatgcttgtctatggcgtcgaacacgccgatgacgctgtatcttgtgatgataacatgcaacaattcattcgaaccattgaagctgccaaatctttaccaacatctcactttagctcagtggttgtgaagataactgccatttgtccaattagtcttctgaaacgagtgagcgatctgctgcggtgggaatacaaaagtccgaacttcaaactctcatggaagctcaaatcgtttccggttttctccgaatcgagtcctctctaccacacaaactcagaaccggaaccgttaaccgcggaagaagaaagggagctcgaagcagctcatggaaggattcaagaaatctgtaggaaatgccaagagtccaatgtaccattgttgattgatgcggaagacacaatcctccaacccgcgatcgattacatggcttattcatcggcgatcatgttcaatgctgacaaagaccgaccaatcgtttacaacacgattcaggcgtacttgagagacgccggtgagagactgcatttggcagtacaaaatgctgagaaagagaatgttcctatggggttcaagttggtgagaggggcttacatgtctagcgaagctagcttggcggattccctgggttgcaagtcgccagtccacgacacaattcaggatactcactcttgttacaatgattgtatgacattcctgatggagaaagcatcaaacggttctggtttcggtgtcgttctcgcaacacataacgctgattcggggagacttgcgtcgaggaaagcgagtgacctcgggatcgataaacagaacgggaagatagagtttgcacagctatatggtatgtcagatgcattgtccttcgggttaaagagagcagggttcaatgttagcaagtacatgccgtttggacccgtcgcaaccgctataccgtatcttctccgacgcgcttatgagaaccggggaatgatggccaccggagctcatgaccgtcaactcatgaggatggaacttaagaggagattaatcgccgggattgcgtaaagagagagtatggagccattaaatgaaattgggaaatgtagatgaataaatttcttctatgtagtttaagaaattgaaaacaaaaaattataatataagaaatggagtaggtaagaacatttcctgtggctaaatatttttcatgagggactatgtttttactatcaatatatcattcacaaatgtatattcaccttatcaataaaaatgctttttactttttt

SEQ ID NO: 430 - protein, 499 aa, Arabidopsis thaliana
  misc_feature (1)..(499): Ceres CDNA ID no. 12683820
  misc_feature (1)..(499): Sequence of endogenous gene to Ceres PROMOTER  YP0212
MATRLLRTNFIRRSYRLPAFSPVGPPTVTASTAVVPEILSFGQQAPEPPLHHPKPTEQSHDGLDLSDQARLFSSIPTSDLLRSTAVLHAAAIGPMVDLGTWVMSSKLMDASVTRGMVLGLVKSTFYDHFCAGEDADAAAERVRSVYEATGLKGMLVYGVEHADDAVSCDDNMQQFIRTIEAAKSLPTSHFSSVVVKITAICPISLLKRVSDLLRWEYKSPNFKLSWKLKSFPVFSESSPLYHTNSEPEPLTAEEERELEAAHGRIQEICRKCQESNVPLLIDAEDTILQPAIDYMAYSSAIMFNADKDRPIVYNTIQAYLRDAGERLHLAVQNAEKENVPMGFKLVRGAYMSSEASLADSLGCKSPVHDTIQDTHSCYNDCMTFLMEKASNGSGFGVVLATHNADSGRLASRKASDLGIDKQNGKIEFAQLYGMSDALSFGLKRAGFNVSKYMPFGPVATAIPYLLRRAYENRGMMATGAHDRQLMRMELKRRLIAGIA

SEQ ID NO: 431 - DNA, 999 bp, Arabidopsis thaliana
  misc_feature (1)..(999): Predicted sequence of Ceres PROMOTER  YP0018
tagaaacctcaacttgaatataatagtttgtttgtttgcttgaagttaatctctctcttttttatcagctaaagctgcatttataaaaattctagtttaacttttaccatttgctataatttagagattttaacaagaaatctggcctagtccgcaaaacttatagaataaatcaaacattcttcaatattttacacatccacaatacccaatccaagaaatggattgcagttgcaccagagattacatgtctcgttttagtttgctagtcactcaaactcacaaagcataaattgtaatagaaaatagaactttatttaaatctgaagaaagatatatataaaaaaaaaaaaaaaagaagaagcaggctccagttttgatgggagaagaaaagagagctggcaacagctattcactgatagaccgatcactctcttctgtcccgcactcttttcttcttttgtttctttcttttcgacagctttcatttttcctccatttttaaatttgaattattttacagtcataaaagtacttcaaacgtatatgtaaataacgagcaacaaaacaattaactacaacaaaactagttctagctaagagaattagttagaaatttttattataatagttagtatatgtttattcataacacaattaattaacacacaaaatacatgtaatttcctctataccctcttcacatataattagagtagtgctttaatttaagattaattatcgatttacatcattaatgatcatctagtcttacacagagagtttcagtatctgcatgagattatataaaggaatgtattcatgtttttacttctttttattcatggttaaggatgatacattataattataaatccataatctatgaactcaactattctttataaaaaaggaattaaattctgaaaataaacaactgtagttggcttcccaaggctgctgcttcacctataaataccctatcctctttgaaaactc

SEQ ID NO: 432 - DNA, 57 bp, Arabidopsis thaliana
  misc_feature (1)..(57): Experimental sequence of Ceres PROMOTER  YP0018
tagaaacctcaacttgaatataatagtttttttgtttgcttgaagataatctctttc

SEQ ID NO: 433 - DNA, 1074 bp, Arabidopsis thaliana
  misc_feature: Encoded by SEQ ID NO: 432
  misc_feature (1)..(1074): Ceres CDNA ID no. 12647555
  misc_feature (1)..(1074): Sequence of endogenous gene to Ceres PROMOTER  YP0018
atctcacatcacaattcacatctcctcgaacaaacaaattataaacccattttccttcataaatttctaaaataaaaccccttaaactttcattcacatcatccaacccccaatgggtcgaatcttgaaccgtaccgtgttaatgactcttctagtcgtaacaatggccggaacagcattctccggtagcttcaacgaagagtttgacttaacttggggtgaacacagaggcaaaatcttcagtggaggaaaaatgttgtcactctcactagaccgggtttccgggtcgggttttaaatccaagaaagaatatttgttcggaagaatcgacatgcagcttaaactcgtcgccggtaactccgctggaaccgtcactgcctactacttgtcatcggaaggaccaacacacgacgagatagactttgagtttcttggtaatgaaacagggaagccttatgttcttcacactaatgtatttgctcaaggcaaaggaaacagagaacaacagttttatctctggtttgatccaaccaagaacttccacacttattctcttgtctggagaccacaacacatcatatttatggtagataatgttccaatcagagtattcaacaatgcagagcaacttggtgttccatttcccaagaaccaaccaatgaagatatactcgagtttatggaatgcagatgattgggctacaagaggtggtttggttaagacagattggtctaaagctcctttcacagcttactacagaggctttaacgctgcagcttgtactgtttcttcagggtcatctttctgtgatcctaagtttaagagttcttttactaatggtgaatctcaagtggctaatgagcttaatgcttatgggagaagaagattaagatgggttcagaagtattttatgatttatgattattgttctgatttaaaaaggtttcctcaaggattcccaccagagtgtaggaagtctagagtctaaaaaccaatgattctctctttgttgttgtttagtgcaaattaaattctctttgttgtttctttaataaattgatttgatttttcttc

SEQ ID NO: 434 - protein, 291 aa, Arabidopsis thaliana
  misc_feature (1)..(291): Ceres CDNA ID no. 12647555
  misc_feature (1)..(291): Sequence of endogenous gene to Ceres PROMOTER  YP0018
MGRILNRTVLMTLLVVTMAGTAFSGSFNEEFDLTWGEHRGKIFSGGKMLSLSLDRVSGSGFKSKKEYLFGRIDMQLKLVAGNSAGTVTAYYLSSEGPTHDEIDFEFLGNETGKPYVLHTNVFAQGKGNREQQFYLWFDPTKNFHTYSLVWRPQHIIFMVDNVPIRVFNNAEQLGVPFPKNQPMKIYSSLWNADDWATRGGLVKTDWSKAPFTAYYRGFNAAACTVSSGSSFCDPKFKSSFTNGESQVANELNAYGRRRLRWVQKYFMIYDYCSDLKRFPQGFPPECRKSRV

SEQ ID NO: 435 - DNA, 999 bp, Arabidopsis thaliana
  misc_feature (1)..(999): Predicted sequence of Ceres PROMOTER  YP0071
ataggccctacttctaattaaagcccatttacttctctccttgtcttcttattcctcttttctccccatcacgtgacgacgatgctataaacgccgtcggattatataactggtgccgttgacaagacggcgacagaagaaagaaagaagaaaccacaggctctagggaacgtaacgttatgtcctgtctatagcatttataacggtcagatcaacgccgtttagataaagatctgtcaatgttaaagaagagatgcatctctacaccgttaaatttaaaacgccgtgaacctcttatctattgatttttgtttgatgaagccaaaacaaatcgtgtcagaagacttatcagagaagaagaaaacgacgacgttcccgtttctccatgtctaataagtgtagtagtggcggctactaaaaactctaaagtttgactccagtaaaactgcctttctagtgtaattccagtgattttagagtttgaatagtgtgtgaccaaatttgaaagtacaatctcagcaatattattgatcactcgttataaaagaatcgaatgtaaaaatagccaatgagagactgagacgtatgtgtttgaccataagtcgtatagtttgtatctatctacctgcaagatcagcagatggttctctgatcaattgtaccttaattatcttttattttcgtaaaatttctctattcacaaatgataaatctacttaagacagtaaccataacaagatttacaagataatttgaaaaatgaacacataaaagtattttggcgcattatttttaataataacaatatttatgtaaagtcacataaaagtatatattcgctcacaaagtcttacggtatttagaacagtagtaccacatcgattctcttcatcttcttcttcataatatgccattgttcatgtctctgtgtcctatcgcataacactcacgctatcttattattttctctcgctctttctcactgagaggacactaaaa

SEQ ID NO: 436 - DNA, 986 bp, Arabidopsis thaliana
  misc_feature (1)..(986): Experimental sequence of Ceres PROMOTER  YP0071
ataggccctacttctaattaaagcccatttacttctctccttgtcttcttattcctcttttctccccatcacgtgacgacgatgctataaacgccgtcggattatataactggtgccgttgacaagacggcgacagaagaaagaaagaagaaaccacaggctctagggaacgtaacgttatgtcctgtctatagcatttataacggtcagatcaacgccgtttagataaagatctgtcaatgttaaagaagagatgcatctctacaccgttaaatttaaaacgccgtgaacctcttatctattgatttttgtttgatgaagccaaaacaaatcgtgtcagaagacttatcagagaagaagaaaacgacgacgttcccgtttctccatgtctaataagtgtagtagtggcggctactaaaaactctaaagtttgactccagtaaaactgcctttctagtgtaattccagtgattttagagtttgaatagtgtgtgaccaaatttgaaagtacaatctcagcaatattattgatcactcgttataaaagaatcgaatgtaaaaatagccaatgagagactgagacgtatgtgtttgaccataagtcgtatagtttgtatctatctacctgcaagatcagcagatggttctctgatcaattgtaccttaattatcttttattttcgtaaaatttctctattcacaaatgataaatctacttaagacagtaaccataacaagatttacaagataatttgaaaaatgaacacataaaagtattttggcgcattatttttaataataacaatatttatgtaaagtcacataaaagtatatattcgctcacaaagtcttacggtatttagaacagtagtaccacatcgattctcttcatcttcttcttcataatatgccattgttcatgtctctgtgtcctatcgcataacactcacgctatcttattattttctctcgctctttctcactga

SEQ ID NO: 437 - DNA, 2943 bp, Arabidopsis thaliana
  misc_feature: Encoded by SEQ ID NO: 436
  misc_feature (1)..(2943): Ceres CDNA ID no. 12721583
  misc_feature (1)..(2943): Sequence of endogenous gene to Ceres PROMOTER  YP0071
atggcgatgagacttttgaagactcatcttctgtttctgcatctgtatctatttttctcaccatgtttcgcttacactgacatggaagttcttctcaatctcaaatcctccatgattggtcctaaaggacacggtctccacgactggattcactcatcttctccggatgctcactgttctttctccggcgtctcatgtgacgacgatgctcgtgttatctctctcaacgtctccttcactcctttgtttggtacaatctcaccagagattgggatgttgactcatttggtgaatctaactttagctgccaacaacttcaccggtgaattaccattggagatgaagagtctaacttctctcaaggttttgaatatctccaacaatggtaaccttactggaacattccctggagagattttaaaagctatggttgatcttgaagttcttgacacttataacaacaatttcaacggtaagttaccaccggagatgtcagagcttaagaagcttaaatacctctctttcggtggaaatttcttcagcggagagattccagagagttatggagatattcaaagcttagagtatcttggtctcaacggagctggactctccggtaaatctccggcgtttctttcccgcctcaagaacttaagagaaatgtatattggctactacaacagctacaccggtggtgttccaccggagttcggtggtttaacaaagcttgagatcctcgacatggcgagctgtacactcaccggagagattccgacgagtttaagtaacctgaaacatctacatactctgtttcttcacatcaacaacttaaccggtcatataccaccggagctttccggtttagtcagcttgaaatctctcgatttatcaatcaatcagttaaccggagaaatccctcaaagcttcatcaatctcggaaacattactctaatcaatctcttcagaaacaatctctacggacaaataccagaggccatcggagaattaccaaaactcgaagtcttcgaagtatgggagaacaatttcacgttacaattaccggcgaatcttggccggaacgggaatctaataaagcttgatgtctctgataatcatctcaccggacttatccccaaggacttatgcagaggtgagaaattagagatgttaattctctctaacaacttcttctttggtccaattccagaagagcttggtaaatgcaaatccttaaccaaaatcagaatcgttaagaatcttctcaacggcactgttccggcggggcttttcaatctaccgttagttacgattatcgaactcactgataatttcttctccggtgaacttccggtaacgatgtccggcgatgttctcgatcagatttacctctctaacaactggttttccggcgagattccacctgcgattggtaatttccccaatctacagactctattcttagatcggaaccgatttcgcggcaacattccgagagaaatcttcgaattgaagcatttatcgaggatcaacacaagtgcgaacaacatcaccggcggtattccagattcaatctctcgctgctcaactttaatctccgtcgatctcagccgtaaccgaatcaacggagaaatccctaaagggatcaacaacgtgaaaaacttaggaactctaaatatctccggtaatcaattaaccggttcaatccctaccggaatcggaaacatgacgagtttaacaactctcgatctctctttcaacgatctctccggtagagtaccactcggtggtcaattcttggtgttcaacgaaacttccttcgccggaaacacttacctctgtctccctcaccgtgtctcttgtccaacacggccaggacaaacctccgatcacaatcacacggcgttgttctcaccgtcaaggatcgtaatcacggttatcgcagcgatcaccggtttgatcctaatcagtgtagcgattcgtcagatgaataagaagaagaaccagaaatctctcgcctggaaactaaccgccttccagaaactagatttcaaatctgaagacgttctcgagtgtcttaaagaagagaacataatcggtaaaggcggagctggaattgtctaccgtggatcaatgccaaacaacgtagacgtcgcgattaaacgactcgttggccgtgggaccgggaggagcgatcatggattcacggcggagattcaaactttggggagaatccgccaccgtcacatagtgagacttcttggttacgtagcgaacaaggatacgaatctccttctttatgagtacatgcctaatggaagccttggagagcttttgcatggatctaaaggtggtcatcttcaatgggagacgagacatagagtagccgtggaagctgcaaagggcttgtgttatcttcaccatgattgttcaccattgatcttgcatagagatgttaagtccaataacattcttttggactctgattttgaagcccatgttgctgattttgggcttgctaagttcttagttgatggtgctgcttctgagtgtatgtcttcaattgctggctcttatggatacatcgccccagagtatgcatataccttgaaagtggacgagaagagtgatgtgtatagtttcggagtggttttgttggagttaatagctgggaagaaacctgttggtgaatttggagaaggagtggatatagttaggtgggtgaggaacacggaagaggagataactcagccatcggatgctgctattgttgttgcgattgttgacccgaggttgactggttacccgttgacaagtgtgattcatgtgttcaagatcgcaatgatgtgtgtggaggaagaagccgcggcaaggcctacgatgagggaagttgtgcacatgctcactaaccctcctaaatccgtggcgaacttgatcgcgttctga

SEQ ID NO: 438 - protein, 980 aa, Arabidopsis thaliana
  misc_feature (1)..(980): Ceres CDNA ID no. 12721583
  misc_feature (1)..(980): Sequence of endogenous gene to Ceres PROMOTER  YP0071
MAMRLLKTHLLFLHLYLFFSPCFAYTDMEVLLNLKSSMIGPKGHGLHDWIHSSSPDAHCSFSGVSCDDDARVISLNVSFTPLFGTISPEIGMLTHLVNLTLAANNFTGELPLEMKSLTSLKVLNISNNGNLTGTFPGEILKAMVDLEVLDTYNNNFNGKLPPEMSELKKLKYLSFGGNFFSGEIPESYGDIQSLEYLGLNGAGLSGKSPAFLSRLKNLREMYIGYYNSYTGGVPPEFGGLTKLEILDMASCTLTGEIPTSLSNLKHLHTLFLHINNLTGHIPPELSGLVSLKSLDLSINQLTGEIPQSFINLGNITLINLFRNNLYGQIPEAIGELPKLEVFEVWENNFTLQLPANLGRNGNLIKLDVSDNHLTGLIPKDLCRGEKLEMLILSNNFFFGPIPEELGKCKSLTKIRIVKNLLNGTVPAGLFNLPLVTIIELTDNFFSGELPVTMSGDVLDQIYLSNNWFSGEIPPAIGNFPNLQTLFLDRNRFRGNIPREIFELKHLSRINTSANNITGGIPDSISRCSTLISVDLSRNRINGEIPKGINNVKNLGTLNISGNQLTGSIPTGIGNMTSLTTLDLSFNDLSGRVPLGGQFLVFNETSFAGNTYLCLPHRVSCPTRPGQTSDHNHTALFSPSRIVITVIAAITGLILISVAIRQMNKKKNQKSLAWKLTAFQKLDFKSEDVLECLKEENIIGKGGAGIVYRGSMPNNVDVAIKRLVGRGTGRSDHGFTAEIQTLGRIRHRHIVRLLGYVANKDTNLLLYEYMPNGSLGELLHGSKGGHLQWETRHRVAVEAAKGLCYLHHDCSPLILHRDVKSNNILLDSDFEAHVADFGLAKFLVDGAASECMSSIAGSYGYIAPEYAYTLKVDEKSDVYSFGVVLLELIAGKKPVGEFGEGVDIVRWVRNTEEEITQPSDAAIVVAIVDPRLTGYPLTSVIHVFKIAMMCVEEEAAARPTMREVVHMLTNPPKSVANLIAF

SEQ ID NO: 439 - DNA, 1952 bp, Unknown; identical to SEQ ID NO: 60
  Promoter and/or promoter control element identified from Arabidopsis thaliana or Oryza sativa.

SEQ ID NO: 440 - DNA, 1033 bp, Unknown
  Promoter and/or promoter control element identified from Arabidopsis thaliana or Oryza sativa.
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaacaaactaaagt

SEQ ID NO: 441 - DNA, 999 bp, Unknown; identical to SEQ ID NO: 200
  Promoter and/or promoter control element identified from Arabidopsis thaliana or Oryza sativa.

SEQ ID NO: 442 - DNA, 1000 bp, Unknown
  Promoter and/or promoter control element identified from Arabidopsis thaliana or Oryza sativa.
ttcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatcca

SEQ ID NO: 443 - DNA, 999 bp, Unknown; identical to SEQ ID NO: 284
  Promoter and/or promoter control element identified from Arabidopsis thaliana or Oryza sativa.

SEQ ID NO: 444 - DNA, 999 bp, Unknown; identical to SEQ ID NO: 305
  Promoter and/or promoter control element identified from Arabidopsis thaliana or Oryza sativa.

SEQ ID NO: 445 - DNA, 1000 bp, Unknown; identical to SEQ ID NO: 341
  Promoter and/or promoter control element identified from Arabidopsis thaliana or Oryza sativa.

SEQ ID NO: 446 - DNA, 1000 bp, Unknown
  Promoter and/or promoter control element identified from Arabidopsis thaliana or Oryza sativa.
aaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctcc

SEQ ID NO: 447 - DNA, 1000 bp, Unknown; identical to SEQ ID NO: 411
  Promoter and/or promoter control element identified from Arabidopsis thaliana or Oryza sativa.

SEQ ID NO: 448 - DNA, 999 bp, Unknown; identical to SEQ ID NO: 64
  Promoter and/or promoter control element identified from Arabidopsis thaliana or Oryza sativa.

SEQ ID NO: 449 - DNA, 915 bp, Unknown; identical to SEQ ID NO: 96
  Promoter and/or promoter control element identified from Arabidopsis thaliana or Oryza sativa.

SEQ ID NO: 450 - DNA, 1000 bp, Unknown; identical to SEQ ID NO: 112
  Promoter and/or promoter control element identified from Arabidopsis thaliana or Oryza sativa.

SEQ ID NO: 451 - DNA, 1000 bp, Unknown; identical to SEQ ID NO: 128
  Promoter and/or promoter control element identified from Arabidopsis thaliana or Oryza sativa.

SEQ ID NO: 452 - DNA, 1000 bp, Unknown; identical to SEQ ID NO: 132
  Promoter and/or promoter control element identified from Arabidopsis thaliana or Oryza sativa.

SEQ ID NO: 453 - DNA, 999 bp, Unknown; identical to SEQ ID NO: 136
  Promoter and/or promoter control element identified from Arabidopsis thaliana or Oryza sativa.

SEQ ID NO: 454 - DNA, 1000 bp, Unknown; identical to SEQ ID NO: 140
  Promoter and/or promoter control element identified from Arabidopsis thaliana or Oryza sativa.

SEQ ID NO: 455 - DNA, 1001 bp, Unknown; identical to SEQ ID NO: 144
  Promoter and/or promoter control element identified from Arabidopsis thaliana or Oryza sativa.

SEQ ID NO: 456 - DNA, 1000 bp, Unknown; identical to SEQ ID NO: 148
  Promoter and/or promoter control element identified from Arabidopsis thaliana or Oryza sativa.

SEQ ID NO: 457 - DNA, 1000 bp, Unknown; identical to SEQ ID NO: 152
  Promoter and/or promoter control element identified from Arabidopsis thaliana or Oryza sativa.

SEQ ID NO: 458 - DNA, 1000 bp, Unknown; identical to SEQ ID NO: 160
  Promoter and/or promoter control element identified from Arabidopsis thaliana or Oryza sativa.

SEQ ID NO: 459 - DNA, 935 bp, Unknown; identical to SEQ ID NO: 164
  Promoter and/or promoter control element identified from Arabidopsis thaliana or Oryza sativa.

SEQ ID NO: 460 - DNA, 1000 bp, Unknown; identical to SEQ ID NO: 168
  Promoter and/or promoter control element identified from Arabidopsis thaliana or Oryza sativa.

SEQ ID NO: 461 - DNA, 1000 bp, Unknown; identical to SEQ ID NO: 172
  Promoter and/or promoter control element identified from Arabidopsis thaliana or Oryza sativa.

SEQ ID NO: 462 - DNA, 1000 bp, Unknown; identical to SEQ ID NO: 176
  Promoter and/or promoter control element identified from Arabidopsis thaliana or Oryza sativa.

SEQ ID NO: 463 - DNA, 1041 bp, Unknown; identical to SEQ ID NO: 180
  Promoter and/or promoter control element identified from Arabidopsis thaliana or Oryza sativa.

SEQ ID NO: 464 - DNA, 975 bp, Unknown
  Promoter and/or promoter control element identified from Arabidopsis thaliana or Oryza sativa.
gataaactgataatggaaaagaacaaagaaaccagtttttaactatttgcatatgtaatttatttgttgcaaattatatttagttaaaatgtttcctctatttatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcgtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaata

SEQ ID NO: 465 - DNA, 999 bp, Unknown; identical to SEQ ID NO: 188
  Promoter and/or promoter control element identified from Arabidopsis thaliana or Oryza sativa.

SEQ ID NO: 466 - DNA, 999 bp, Unknown; identical to SEQ ID NO: 192
  Promoter and/or promoter control element identified from Arabidopsis thaliana or Oryza sativa.

SEQ ID NO: 467 - DNA, 999 bp, Unknown; identical to SEQ ID NO: 196
  Promoter and/or promoter control element identified from Arabidopsis thaliana or Oryza sativa.

SEQ ID NO: 468 - DNA, 999 bp, Unknown; identical to SEQ ID NO: 204
  Promoter and/or promoter control element identified from Arabidopsis thaliana or Oryza sativa.

SEQ ID NO: 469 - DNA, 999 bp, Unknown; identical to SEQ ID NO: 208
  Promoter and/or promoter control element identified from Arabidopsis thaliana or Oryza sativa.

SEQ ID NO: 470 - DNA, 999 bp, Unknown; identical to SEQ ID NO: 212
  Promoter and/or promoter control element identified from Arabidopsis thaliana or Oryza sativa.

SEQ ID NO: 471 - DNA, 999 bp, Unknown; identical to SEQ ID NO: 220
  Promoter and/or promoter control element identified from Arabidopsis thaliana or Oryza sativa.

SEQ ID NO: 472 - DNA, 999 bp, Unknown; identical to SEQ ID NO: 224
  Promoter and/or promoter control element identified from Arabidopsis thaliana or Oryza sativa.

SEQ ID NO: 473 - DNA, 999 bp, Unknown; identical to SEQ ID NO: 232
  Promoter and/or promoter control element identified from Arabidopsis thaliana or Oryza sativa.

SEQ ID NO: 474 - DNA, 998 bp, Unknown; identical to SEQ ID NO: 236
  Promoter and/or promoter control element identified from Arabidopsis thaliana or Oryza sativa.

SEQ ID NO: 475 - DNA, 999 bp, Unknown; identical to SEQ ID NO: 240
  Promoter and/or promoter control element identified from Arabidopsis thaliana or Oryza sativa.

SEQ ID NO: 476 - DNA, 999 bp, Unknown; identical to SEQ ID NO: 244
  Promoter and/or promoter control element identified from Arabidopsis thaliana or Oryza sativa.

SEQ ID NO: 477 - DNA, 999 bp, Unknown; identical to SEQ ID NO: 252
  Promoter and/or promoter control element identified from Arabidopsis thaliana or Oryza sativa.

SEQ ID NO: 478 - DNA, 990 bp, Unknown; identical to SEQ ID NO: 256
  Promoter and/or promoter control element identified from Arabidopsis thaliana or Oryza sativa.

SEQ ID NO: 479 - DNA, 999 bp, Unknown; identical to SEQ ID NO: 260
  Promoter and/or promoter control element identified from Arabidopsis thaliana or Oryza sativa.

SEQ ID NO: 480 - DNA, 996 bp, Unknown; identical to SEQ ID NO: 264
  Promoter and/or promoter control element identified from Arabidopsis thaliana or Oryza sativa.

SEQ ID NO: 481 - DNA, 999 bp, Unknown; identical to SEQ ID NO: 268
  Promoter and/or promoter control element identified from Arabidopsis thaliana or Oryza sativa.

SEQ ID NO: 482 - DNA, 999 bp, Unknown; identical to SEQ ID NO: 272
  Promoter and/or promoter control element identified from Arabidopsis thaliana or Oryza sativa.

SEQ ID NO: 483 - DNA, 999 bp, Unknown; identical to SEQ ID NO: 276
  Promoter and/or promoter control element identified from Arabidopsis thaliana or Oryza sativa.

SEQ ID NO: 484 - DNA, 999 bp, Unknown; identical to SEQ ID NO: 280
  Promoter and/or promoter control element identified from Arabidopsis thaliana or Oryza sativa.

SEQ ID NO: 485 - DNA, 999 bp, Unknown; identical to SEQ ID NO: 288
  Promoter and/or promoter control element identified from Arabidopsis thaliana or Oryza sativa.

SEQ ID NO: 486 - DNA, 999 bp, Unknown; identical to SEQ ID NO: 296
  Promoter and/or promoter control element identified from Arabidopsis thaliana or Oryza sativa.

SEQ ID NO: 487 - DNA, 999 bp, Unknown; identical to SEQ ID NO: 300
  Promoter and/or promoter control element identified from Arabidopsis thaliana or Oryza sativa.

SEQ ID NO: 488 - DNA, 1823 bp, Unknown
  Promoter and/or promoter control element identified from Arabidopsis thaliana or Oryza sativa.
gtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgatgtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatagttgatggttgatgtatttttgttgattctgatgtttcgatttttgtttttgttttgacagct

SEQ ID NO: 489 - DNA, 1539 bp, Unknown
  Promoter and/or promoter control element identified from Arabidopsis thaliana or Oryza sativa.
aagcttatgtcaaaaatatttaattaaaatatatgtaatttatatgttgattgagttatgagtatcaagtaaaaaccctaatccgttattaaaatatcaatgattataacgtatttataaacgaaaaaaaaaagaacatctagaattttcgatatttgatcctcaagttaaacttggaaaaatttggatgtatgaaatattttgtcgtccacttatacaataaagtatgaaacatggatgcatgaaggctagacatccaatgtctaaaaatactatatataatgcttttggtagggtcttttctttatcatgtctcacttctgtttctatccctcattttaaatagccaatataatttcactctttactataaaattattatataaacatcattttgattgaactacctaaaaggaagaaacgtataggaatttttggagcctcaagattgtaataatgtctcatagtttgacttgcaaaagctaaattaaacgcctaaatcattaccattaaataaatgaacttttgtacgcaattgattcagacacaaggaccgaccaattcgaaaacaatgaatggatatgattcatccttatgaaagcttgacaacaaactcggttttggctggttaacctagactcggtttatttaaaccagacaataatttctttcgtcgtcgttttatttgaataggtgcgtcaaaaataaaagctgaaattcttggttgcaaaagcccaacaggcctgtggagatagctttttagattgattaaatgggccgaattgggctgacacatgacgagaatgtggctatagaaattgttagtgagagggtccgggtccaaaaatgttgcagaagtgatatagtatttatttaattaaaaacatattattcgacgtatttttaacgctcactggatttataagtagagattttttgtgtctcacaaaaacaaaaaaatcatcgtgaaacgttcgaaggccattttctttggacgaccatcggcgttaaggagagagcttagatctcgtgccgtcgtgcgacgttgttttccggtacgtttattcctgttgattccttctctgtctctctcgattcactgctacttctgtttggattcctttcgcgcgatctctggatccgtgcgttattcattggctcgtcgttttcagatctgttgcgtttcttctgttttctgttatgagtggatgcgttttcttgtgattcgcttgtttgtaatgctggatctgtatctgcgtcgtgggaattcaaagtgatagtagttgatattttttccagatcaggcatgttctcgtataatcaggtctaatggttgatgattctgcggaattatagatctaagatcttgattgatttagatttgaggatatgaatgagattcgtaggtccacaaaggtcttgttatctctgctgctagatagatgattatccaattgcgtttcgtagttatttttatggattcaaggaattgcgtgtaattgagagttttactctgttttgtgaacaggcttgatcaaa

SEQ ID NO: 490 - DNA, 1954 bp, Unknown
  Promoter and/or promoter control element identified from Arabidopsis thaliana or Oryza sativa.
gtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaa

SEQ ID NO: 491 - DNA, 999 bp, Unknown; identical to SEQ ID NO: 431
  Promoter and/or promoter control element identified from Arabidopsis thaliana or Oryza sativa.

SEQ ID NO: 492 - DNA, 999 bp, Unknown; identical to SEQ ID NO: 435
  Promoter and/or promoter control element identified from Arabidopsis thaliana or Oryza sativa.

SEQ ID NO: 493 - DNA, 999 bp, Unknown; identical to SEQ ID NO: 88
  Promoter and/or promoter control element identified from Arabidopsis thaliana or Oryza sativa.

SEQ ID NO: 494 - DNA, 999 bp, Unknown; identical to SEQ ID NO: 108
  Promoter and/or promoter control element identified from Arabidopsis thaliana or Oryza sativa.

SEQ ID NO: 495 - DNA, 999 bp, Unknown; identical to SEQ ID NO: 92
  Promoter and/or promoter control element identified from Arabidopsis thaliana or Oryza sativa.

SEQ ID NO: 496 - DNA, 999 bp, Unknown
  Promoter and/or promoter control element identified from Arabidopsis thaliana or Oryza sativa.
ttttgtttctaatagtttgatgtttatatcaacattattatttactttcatttgttaccgatagaaagaggagaaaattgttgacaaaaacaaagaaaaaagtaaaattaatattattaaattaataaaaataacaaactgtaaaagctatttttaaaaatttttcttgtaaaacatctaaaaattattcttgtagaaacagaggaatatcattgaagataatagtgtgaaattatatatatatatagaaatatataaagtaggatttttttctgtatacaaatatacgtttccaattttatcaaaaactgtaaagatttttttctttgtcagtacctgctaaacttgttaatttttttattaaaaaaaaatcaaattacaattcttctataatcattttaaattccatttctttataccacaaaagattatattgcctttatcgtctttggtatgtatgcgtgaatatatttatttattttcttttctttcattttctttttaaagaactttataaatgaaataaggaacaaacaatatacacatgtactaacgtatataaataatatcatcaatatctatccaaaacttggatttcatggttgacgtggcccaaccaaaatctcaagttctctgcggatgacgaaccatctcaccatctctttttttctctctcttttttttttttaatatcatcagcacggttacataaaattcgtgatccatgaagttggctttcttgtcgttttacttcatcaccccatttttttaaagtctccatctttatacttcttcaactctccaccaccaccattgtcaccaccacatttaaacacacactttcacttgtagtgggattcgaaagtgcgttttattcatttgttttactgtttttgataacctcaaaatttgcctaaattttattctctataaatccttatatgttttacttacattcctaaagttttcaactttcttgagcttcaaaaagtacctcca

SEQ ID NO: 497 - DNA, 999 bp, Unknown; identical to SEQ ID NO: 104
  Promoter and/or promoter control element identified from Arabidopsis thaliana or Oryza sativa.

SEQ ID NO: 498 - DNA, 998 bp, Unknown; identical to SEQ ID NO: 116
  Promoter and/or promoter control element identified from Arabidopsis thaliana or Oryza sativa.
  misc_feature (489)..(489): n is a, c, g, or t

SEQ ID NO: 499 - DNA, 999 bp, Unknown; identical to SEQ ID NO: 120
  Promoter and/or promoter control element identified from Arabidopsis thaliana or Oryza sativa.

SEQ ID NO: 500 - DNA, 999 bp, Unknown; identical to SEQ ID NO: 76
  Promoter and/or promoter control element identified from Arabidopsis thaliana or Oryza sativa.

SEQ ID NO: 501 - DNA, 999 bp, Unknown; identical to SEQ ID NO: 80
  Promoter and/or promoter control element identified from Arabidopsis thaliana or Oryza sativa.

SEQ ID NO: 502 - DNA, 999 bp, Unknown; identical to SEQ ID NO: 84
  Promoter and/or promoter control element identified from Arabidopsis thaliana or Oryza sativa.

SEQ ID NO: 503 - DNA, 882 bp, Unknown; identical to SEQ ID NO: 124
  Promoter and/or promoter control element identified from Arabidopsis thaliana or Oryza sativa.

SEQ ID NO: 504 - DNA, 999 bp, Unknown; identical to SEQ ID NO: 100
  Promoter and/or promoter control element identified from Arabidopsis thaliana or Oryza sativa.

SEQ ID NO: 505 - DNA, 19 bp, Artificial Sequence
  oligo(dT)18 primer
ttttttttttttttttttv

SEQ ID NO: 506 - DNA, 19 bp, Artificial Sequence
  oligo dTV primer
  misc_feature (19)..(19): n is a, c, or g
ttttttttttttttttttn

SEQ ID NO: 507 - DNA, 19 bp, Artificial Sequence
  Synthetic oligo(dT)18 primer
ttttttttttttttttttv

SEQ ID NO: 508 - DNA, 19 bp, Artificial Sequence
  Synthetic oligo dTV primer
  misc_feature (19)..(19): n is a, c, or g
ttttttttttttttttttn

SEQ ID NO: 509 - DNA, 930 bp, Arabidopsis thaliana
ctaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttga

SEQ ID NO: 510 - DNA, 86 bp, Arabidopsis thaliana
ccaaaagaacatctttccttcgaattttctttcattaacatttcttttacttgtctccttgtgtcttcacttcacatcacaacatg

SEQ ID NO: 511 - DNA, 949 bp, Arabidopsis thaliana; identical to SEQ ID NO: 4

SEQ ID NO: 512 - protein, 195 aa, Arabidopsis thaliana; identical to SEQ ID NO: 5

SEQ ID NO: 513 - DNA, 963 bp, Arabidopsis thaliana; identical to SEQ ID NO: 6

SEQ ID NO: 514 - DNA, 1627 bp, Arabidopsis thaliana; identical to SEQ ID NO: 7

SEQ ID NO: 515 - protein, 413 aa, Arabidopsis thaliana; identical to SEQ ID NO: 8

SEQ ID NO: 516 - DNA, 950 bp, Arabidopsis thaliana; identical to SEQ ID NO: 9

SEQ ID NO: 517 - DNA, 2310 bp, Arabidopsis thaliana; identical to SEQ ID NO: 10

SEQ ID NO: 518 - protein, 599 aa, Arabidopsis thaliana; identical to SEQ ID NO: 11

SEQ ID NO: 519 - DNA, 950 bp, Arabidopsis thaliana; identical to SEQ ID NO: 12

SEQ ID NO: 520 - DNA, 1538 bp, Arabidopsis thaliana; identical to SEQ ID NO: 13

SEQ ID NO: 521 - protein, 406 aa, Arabidopsis thaliana; identical to SEQ ID NO: 14

SEQ ID NO: 522 - DNA, 950 bp, Arabidopsis thaliana; identical to SEQ ID NO: 15

SEQ ID NO: 523 - DNA, 1720 bp, Arabidopsis thaliana; identical to SEQ ID NO: 16

SEQ ID NO: 524 - protein, 500 aa, Arabidopsis thaliana; identical to SEQ ID NO: 17

SEQ ID NO: 525 - DNA, 950 bp, Arabidopsis thaliana; identical to SEQ ID NO: 18

SEQ ID NO: 526 - DNA, 1193 bp, Arabidopsis thaliana; identical to SEQ ID NO: 19

SEQ ID NO: 527 - protein, 231 aa, Arabidopsis thaliana
MSKKQRLSEEDGEVEIELDLGLSLNGRFGVDPLAKTRLMRSTSVLDLVVNDRSGLSRTCSLPVETEEEWRKRKELQSLRRLEAKRKRSEKQRKHKACGGEEKVVEEGSIGSSGSGSSGLSEVDTLLPPVQATTNKSVETSPSSAQSQPENLGKEASQNIIEDMPFVSTTGDGPNGKKINGFLYRYRKGEEVRIVCVCHGSFLSPAEFVKHAGGGDVAHPLKHIVVNPSPFL

SEQ ID NO: 528 - DNA, 950 bp, Arabidopsis thaliana; identical to SEQ ID NO: 21

SEQ ID NO: 529 - DNA, 995 bp, Arabidopsis thaliana; identical to SEQ ID NO: 22

SEQ ID NO: 530 - protein, 236 aa, Arabidopsis thaliana; identical to SEQ ID NO: 23

SEQ ID NO: 531 - DNA, 950 bp, Arabidopsis thaliana
agaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatata

SEQ ID NO: 532 - DNA, 124 bp, Arabidopsis thaliana
tgtatgtttttgttccctattatatcttctagcttctttcttcctcttcttccttaaaaattcatcctccaaaacattctatcatcaacgaaacatttcatattaaattaaataataatcgatg

SEQ ID NO: 533 - DNA, 1685 bp, Arabidopsis thaliana; identical to SEQ ID NO: 25

SEQ ID NO: 534 - protein, 468 aa, Arabidopsis thaliana; identical to SEQ ID NO: 26

SEQ ID NO: 535 - DNA, 950 bp, Arabidopsis thaliana; identical to SEQ ID NO: 27

SEQ ID NO: 536 - DNA, 2828 bp, Arabidopsis thaliana; identical to SEQ ID NO: 28

SEQ ID NO: 537 - protein, 824 aa, Arabidopsis thaliana; identical to SEQ ID NO: 29

SEQ ID NO: 538 - DNA, 950 bp, Arabidopsis thaliana
tacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaagttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatca

SEQ ID NO: 539 - DNA, 104 bp, Arabidopsis thaliana
cagctcctttctactaaaacccttttactataaattctacgtacacgtaccacttcttctcctcaaattcatcaaacccatttctattccaactcccaaaaatg

SEQ ID NO: 540 - DNA, 1521 bp, Arabidopsis thaliana; identical to SEQ ID NO: 31

SEQ ID NO: 541 - protein, 392 aa, Arabidopsis thaliana; identical to SEQ ID NO: 32

SEQ ID NO: 542 - DNA, 950 bp, Arabidopsis thaliana
acttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagtttttttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataag

SEQ ID NO: 543 - DNA, 700 bp, Arabidopsis thaliana; identical to SEQ ID NO: 34

SEQ ID NO: 544 - protein, 152 aa, Arabidopsis thaliana; identical to SEQ ID NO: 35

SEQ ID NO: 545 - DNA, 947 bp, Arabidopsis thaliana
caaacaattactgctcaatgtatttgcgtatagagcatgtccaataccatgcctcatgatgtgagattgcgaggcggagtcagagaacgagttaaagtgacgacgttttttttgttttttttgggcatagtgtaaagtgatattaaaatttcatggttggcaggtgactgaaaataaaaatgtgtataggatgtgtttatatgctgacggaaaaatagttactcaactaatacagatctttataaagagtatataagtctatggttaatcatgaatggcaatatataagagtagatgagatttatgtttatattgaaacaagggaaagatatgtgtaattgaaacaatggcaaaatataagtcaaatcaaactggtttctgataatatatgtgttgaatcaatgtatatcttggtattcaaaaccaaaacaactacaccaatttctttaaaaaaccagttgatctaataactacattttaatactagtagctattagctgaatttcataatcaatttcttgcattaaaatttaaagtgggttttgcatttaaacttactcggtttgtattaatagactttcaaagattaaaagaaaactactgcattcagagaataaagctatcttactaaacactacttttaaagtttcttttttcacttattaatcttcttttacaaatggatctgtctctctgcatggcaaaatatcttacactaattttattttctttgtttgataacaaatttatcggctaagcatcacttaaatttaatacacgttatgaagacttaaaccacgtcacactataagaaccttacaggctgtcaaacacccttccctacccactcacatctctccacgtggcaatctttgatattgacaccttagccactacagctgtcacactcctctctcggtttcaaaacaacatctctggtataaata

SEQ ID NO: 546 - DNA, 53 bp, Arabidopsis thaliana
aatcaaaacctctcctatatctcttcaatctgatataactacccttctcaatg

SEQ ID NO: 547 - DNA, 1218 bp, Arabidopsis thaliana; identical to SEQ ID NO: 37

SEQ ID NO: 548 - protein, 305 aa, Arabidopsis thaliana; identical to SEQ ID NO: 38

SEQ ID NO: 549 - DNA, 950 bp, Arabidopsis thaliana; identical to SEQ ID NO: 39

SEQ ID NO: 550 - DNA, 837 bp, Arabidopsis thaliana; identical to SEQ ID NO: 40

SEQ ID NO: 551 - protein, 278 aa, Arabidopsis thaliana; identical to SEQ ID NO: 41

SEQ ID NO: 552 - DNA, 950 bp, Arabidopsis thaliana; identical to SEQ ID NO: 42

SEQ ID NO: 553 - DNA, 1747 bp, Arabidopsis thaliana; identical to SEQ ID NO: 43

SEQ ID NO: 554 - protein, 514 aa, Arabidopsis thaliana; identical to SEQ ID NO: 44

SEQ ID NO: 555 - DNA, 950 bp, Arabidopsis thaliana; identical to SEQ ID NO: 45

SEQ ID NO: 556 - DNA, 3048 bp, Arabidopsis thaliana; identical to SEQ ID NO: 46

SEQ ID NO: 557 - protein, 1015 aa, Arabidopsis thaliana; identical to SEQ ID NO: 47

SEQ ID NO: 558 - DNA, 960 bp, Arabidopsis thaliana; identical to SEQ ID NO: 48

SEQ ID NO: 559 - DNA, 1194 bp, Arabidopsis thaliana; identical to SEQ ID NO: 49

SEQ ID NO: 560 - protein, 239 aa, Arabidopsis thaliana; identical to SEQ ID NO: 50

SEQ ID NO: 561 - DNA, 950 bp, Arabidopsis thaliana; identical to SEQ ID NO: 51

SEQ ID NO: 562 - DNA, 918 bp, Arabidopsis thaliana; identical to SEQ ID NO: 52

SEQ ID NO: 563 - protein, 305 aa, Arabidopsis thaliana; identical to SEQ ID NO: 53

SEQ ID NO: 564 - DNA, 950 bp, Arabidopsis thaliana
cgctccagaccactgtttgctttcctctgattaaccaatctcaattaaactactaatttataattcaagataattagataaccaatcttaaaatttggaatcttcttccctcacttgatattacaaaaaaaaaactgatttatcatacggttaattcaagaaaacagcaaaaaaattgcactataatgcaaaacatcaattaattacattcgattaaaaaatcatcattgaatctaaaatggcctcaaatctattgagcatttgtcatgtgcctaaaatggttcaggagttttacatctaatcacataaaaagcaaacaataaccaaaaaaattgcattttagcaaatcaaatacttatatatatacgtatgattaagcgtcatgactttaaaacctctgtaaaattttgatttatttttcgatgcttttattttttaaccaatagtaataaagtccaaatcttaaatacgaaaaaatgtttctttctaagcgaccaacaaaatggtccaaatcacagaaaatgttccataatccaggcccattaagctaatcaccaagtaatacattacacgtcaccaattaatacattacacgtacggccttctctcttcacgagtaatatgcaaacaaacgtacattagctgtaatgtactcactcatgcaacgtcttaacctgccacgtattacgtaattacaccactccttgttcctaacctacgcatttcactttagcgcatgttagtcaaaaaacacaaacataaactacaaataaaaaaactcaaaacaaaacccaatgaacgaacggaccagccccgtctcgattgatggaacagtgacaacagtcccgttttctcgggcataacggaaacggtaaccgtctctctgtttcatttgcaacaacaccatttttataaataaaaacacatttaaataaaaaattattaaaacc

SEQ ID NO: 565 - DNA, 153 bp, Arabidopsis thaliana
tatatccaaacaaatgaatgtgttaaaccttcactcttctctccacacaaaattcaaaaacctcacatttcacttctctcttctcgcttcttctagatctcaccggtttatctagctccggtttgattcatctccggttatggggagagaatg

SEQ ID NO: 566 - DNA, 2017 bp, Arabidopsis thaliana; identical to SEQ ID NO: 55

SEQ ID NO: 567 - protein, 339 aa, Arabidopsis thaliana; identical to SEQ ID NO: 56

SEQ ID NO: 568 - DNA, 950 bp, Arabidopsis thaliana; identical to SEQ ID NO: 57

SEQ ID NO: 569 - DNA, 703 bp, Arabidopsis thaliana; identical to SEQ ID NO: 58

SEQ ID NO: 570 - protein, 157 aa, Arabidopsis thaliana; identical to SEQ ID NO: 59

SEQ ID NO: 571 - DNA, 19 bp, Artificial Sequence
  Synthetic oligonucleotide primer
ttttttttttttttttttv

SEQ ID NO: 572 - DNA, 1019 bp, Arabidopsis thaliana
gaggtcagtgaagtcgattgggatttggttgataacgttttactcgactaattatatacttcagaaggatagtaatagaataccaaaataattaaatgattggttagtgccttagtggagactttttaaccgattctaatagactaatgatgtagctaagcattatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcatatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaaca

SEQ ID NO: 573 - DNA, 1023 bp, Arabidopsis thaliana
aagaagtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttttaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactgatagtcactttggaactgagtagatatttgcatcttgagttaccatggactcaaaagtccaaaaagagaccccgagtgaaaatgctaccaacttaataacaaagaagaatttacagcggtcaaaaagtatctataaatggttacacaacagtagtcataagca

SEQ ID NO: 574 - DNA, 1005 bp, Arabidopsis thaliana
ttattgttgaaacggatggtatccagattcatagagttatacgttgttgacctcgtacaggatgaattcattatcttcttcttcttttgcagcatggcaggtgatcgatgggtatgacttgtgatgatagccatgtccaccaaatcagccaagaaaagatcaagacctcggctgcttacgttctgttctataaacgccttgtagactaaagaaactgaagcggaaaagacaagaaagaggtatttgcatttttgccgggtttggcttatttaaaaacatcattggcttgattctaattcactacaagatcaagatgaaagcagctctgcgttgaggctaatttacagaagagagagagagagttgggaagaagagcaaaagaccgagaggacatgttgcggggaatttattttattcttacaaaaattggtatctgattattttattaaccatattcaattagagaatagaagaatagagaaaagcccttttgtgggatatggttctaaattgttgtttagttcttgtgtgtcagttttggctctcgtcgaccaaagaagattaaagaaacctctaccttattttaactcaattcttttgtttttgcaatgtcctttgctttccaaaattgttagtcttacttttcactactttgatagacattgcctttgcgtttccctgattaataagccagagtacttaaatcaaaattgactgttttgtgcatcctgcatcacgtttccaatcagaaccatagtgttgtcgttgtgtcattatccgaatttaagtggagacattggtaagttatttataaactaattacaatctatttttctaattatttcaaataacatatttaagctctgtagcttccactagacggtgaagatttgaagtgagagctctctttgcattgctcacccaccaatggatctacctacccttcttcttcttctccgccttttaaaccctaaaagtttctctttccttcaacaacgccacaat

SEQ ID NO: 575 - DNA, 1002 bp, Arabidopsis thaliana
ggaacgttagctgctatagcaaagcatggaatggcaatgtcagatccggaacctgaaataaacgtgtatcagatcgcttcttcggcgataaacccgctggttttcgaagacttagcggagcttctttataaccactacaaaacatctccatgcatggactctaaaggtgatcctattatggtgcgtttgatgaaacttttcaattccgttgatgatttctcggatcatttgtggagagatgctcaagaacggagtgggttgatgagtggtatgagttcagtggatagtaagatgatgcagaagctaaagtttatatgcaagaaatctgttgaacaagccaaacaccttgctactatttatgagccatacactttctatggtggaaggtaagacagaactcattaacattctaattcttagagcagacaaaaccggtacccgcaaagttttcatcttttttttttggtttcttttacagatttgataacagcaatacacagagattaatggagaatatgtcagaggacgagaagagagaatttggatttgatgttggaagcattaactggacggactacattacaaacgttcacattcccggtttaagaaggcatgtcttgaaaggaagagcttaactttgaatctcactaaaccagaccaaacagaatcgatcccttcttttatctttttatctttttcttttttcattacgtgtaatcgtgttgtgtctaatatatcagtttgatttgtaataatttgaaaaaaaacggaaatgttgttatctttaagtttgcccaaaatctatagtcatgttcgattcaagacaaagtttaaagttacaacctgtaaaaatattaatagtctctgatgtaaacgtatcttaaacaaaattattaaatgttgaagttagtaacatacaattattaatgaataaatgtttaatcaattaaatgtcatttagtgattgtcctataaaatctcttgttttcttgttttatatta

SEQ ID NO: 576 - DNA, 1952 bp, Arabidopsis thaliana; identical to SEQ ID NO: 60
  misc_feature (1)..(1952): Ceres Promoter construct YP0001 as found in Promoter Report #1

SEQ ID NO: 577 - DNA, 1033 bp, Arabidopsis thaliana; identical to SEQ ID NO: 440
  misc_feature (1)..(1033): Ceres Promoter construct YP0007 as found in Promoter Report #2

SEQ ID NO: 578 - DNA, 999 bp, Arabidopsis thaliana; identical to SEQ ID NO: 200
  misc_feature (1)..(999): Ceres Promoter construct G0013 as found in Promoter Report #3

SEQ ID NO: 579 - DNA, 1000 bp, Arabidopsis thaliana; identical to SEQ ID NO: 442
  misc_feature (1)..(1000): Ceres Promoter construct YP0097 as found in Promoter Report #4

SEQ ID NO: 580 - DNA, 999 bp, Arabidopsis thaliana; identical to SEQ ID NO: 284
  misc_feature (1)..(999): Ceres Promoter construct YP0111 as found in Promoter Report #5

SEQ ID NO: 581 - DNA, 999 bp, Arabidopsis thaliana; identical to SEQ ID NO: 305
  misc_feature (1)..(999): Ceres Promoter construct YP0104 as found in Promoter Report #6

SEQ ID NO: 582 - DNA, 1000 bp, Arabidopsis thaliana; identical to SEQ ID NO: 341
  misc_feature (1)..(1000): Ceres Promoter construct YP0075 as found in Promoter Report #7

SEQ ID NO: 583 - DNA, 1000 bp, Arabidopsis thaliana; identical to SEQ ID NO: 446
  misc_feature (1)..(1000): Ceres Promoter construct YP0016 as found in Promoter Report #8

SEQ ID NO: 584 - DNA, 1000 bp, Arabidopsis thaliana; identical to SEQ ID NO: 411
  misc_feature (1)..(1000): Ceres Promoter construct YP0094 as found in Promoter Report #9

SEQ ID NO: 585 - DNA, 999 bp, Arabidopsis thaliana; identical to SEQ ID NO: 64
  misc_feature (1)..(999): Ceres Promoter construct YP0033 as found in Promoter Report #10

SEQ ID NO: 586 - DNA, 915 bp, Arabidopsis thaliana; identical to SEQ ID NO: 96
  misc_feature (1)..(915): Ceres Promoter construct YP0049 as found in Promoter Report #11

SEQ ID NO: 587 - DNA, 1000 bp, Arabidopsis thaliana; identical to SEQ ID NO: 112
  misc_feature (1)..(1000): Ceres Promoter construct YP0060 as found in Promoter Report #12

SEQ ID NO: 588 - DNA, 1000 bp, Arabidopsis thaliana; identical to SEQ ID NO: 128
  misc_feature (1)..(1000): Ceres Promoter construct YP0092 as found in Promoter Report #13

SEQ ID NO: 589 - DNA, 1000 bp, Arabidopsis thaliana; identical to SEQ ID NO: 132
  misc_feature (1)..(1000): Ceres Promoter construct YP0113 as found in Promoter Report #14

SEQ ID NO: 590 - DNA, 999 bp, Oryza sativa; identical to SEQ ID NO: 136
  misc_feature (1)..(999): Ceres Promoter construct YP0095 as found in Promoter Report #15

SEQ ID NO: 591 - DNA, 1000 bp, Arabidopsis thaliana; identical to SEQ ID NO: 140
  misc_feature (1)..(1000): Ceres Promoter construct YP0102 as found in Promoter Report #16

SEQ ID NO: 592 - DNA, 1001 bp, Arabidopsis thaliana; identical to SEQ ID NO: 144
  misc_feature (1)..(1001): Ceres Promoter construct YP0103 as found in Promoter Report #17

SEQ ID NO: 593 - DNA, 1000 bp, Arabidopsis thaliana; identical to SEQ ID NO: 148
  misc_feature (1)..(1000): Ceres Promoter construct YP0107 as found in Promoter Report #18

SEQ ID NO: 594 - DNA, 1000 bp, Arabidopsis thaliana; identical to SEQ ID NO: 152
  misc_feature (1)..(1000): Ceres Promoter construct YP0110 as found in Promoter Report #19

SEQ ID NO: 595 - DNA, 1000 bp, Arabidopsis thaliana; identical to SEQ ID NO: 160
  misc_feature (1)..(1000): Ceres Promoter construct YP0112 as found in Promoter Report #20

SEQ ID NO: 596 - DNA, 935 bp, Arabidopsis thaliana; identical to SEQ ID NO: 164
  misc_feature (1)..(935): Ceres Promoter construct YP0116 as found in Promoter Report #21

SEQ ID NO: 597 - DNA, 1000 bp, Arabidopsis thaliana; identical to SEQ ID NO: 168
  misc_feature (1)..(1000): Ceres Promoter construct YP0117 as found in Promoter Report #22

SEQ ID NO: 598 - DNA, 1000 bp, Arabidopsis thaliana; identical to SEQ ID NO: 172
  misc_feature (1)..(1000): Ceres Promoter construct YP0118 as found in Promoter Report #23

SEQ ID NO: 599 - DNA, 1000 bp, Arabidopsis thaliana; identical to SEQ ID NO: 176
  misc_feature (1)..(1000): Ceres Promoter construct YP0126 as found in Promoter Report #24

SEQ ID NO: 600 - DNA, 1041 bp, Arabidopsis thaliana; identical to SEQ ID NO: 180
  misc_feature (1)..(1041): Ceres Promoter construct YP0127 as found in Promoter Report #25

SEQ ID NO: 601 - DNA, 975 bp, Arabidopsis thaliana; identical to SEQ ID NO: 464
  misc_feature (1)..(975): Ceres Promoter construct YP0128 as found in Promoter Report #26

SEQ ID NO: 602 - DNA, 999 bp, Arabidopsis thaliana; identical to SEQ ID NO: 188
  misc_feature (1)..(999): Ceres Promoter construct YP0020 as found in Promoter Report #27

SEQ ID NO: 603 - DNA, 999 bp, Arabidopsis thaliana; identical to SEQ ID NO: 192
  misc_feature (1)..(999): Ceres Promoter construct YP0022 as found in Promoter Report #28

SEQ ID NO: 604 - DNA, 999 bp, Arabidopsis thaliana; identical to SEQ ID NO: 196
  misc_feature (1)..(999): Ceres Promoter construct YP0024 as found in Promoter Report #29

SEQ ID NO: 605 - DNA, 999 bp, Arabidopsis thaliana; identical to SEQ ID NO: 204
  misc_feature (1)..(999): Ceres Promoter construct YP0028 as found in Promoter Report #30

SEQ ID NO: 606 - DNA, 999 bp, Arabidopsis thaliana; identical to SEQ ID NO: 208
  misc_feature (1)..(999): Ceres Promoter construct YP0030 as found in Promoter Report #31

SEQ ID NO: 607 - DNA, 999 bp, Arabidopsis thaliana; identical to SEQ ID NO: 212
  misc_feature (1)..(999): Ceres Promoter construct YP0054 as found in Promoter Report #32

SEQ ID NO: 608 - DNA, 999 bp, Arabidopsis thaliana; identical to SEQ ID NO: 220
  misc_feature (1)..(999): Ceres Promoter construct YP0050 as found in Promoter Report #34

SEQ ID NO: 609 - DNA, 999 bp, Arabidopsis thaliana; identical to SEQ ID NO: 224
  misc_feature (1)..(999): Ceres Promoter construct YP0040 as found in Promoter Report #35

SEQ ID NO: 610 - DNA, 999 bp, Arabidopsis thaliana; identical to SEQ ID NO: 232
  misc_feature (1)..(999): Ceres Promoter construct YP0056 as found in Promoter Report #37

SEQ ID NO: 611 - DNA, 998 bp, Arabidopsis thaliana; identical to SEQ ID NO: 236
  misc_feature (1)..(998): Ceres Promoter construct YP0068 as found in Promoter Report #38

SEQ ID NO: 612 - DNA, 999 bp, Arabidopsis thaliana; identical to SEQ ID NO: 240
  misc_feature (1)..(999): Ceres Promoter construct YP0082 as found in Promoter Report #39

SEQ ID NO: 613 - DNA, 999 bp, Arabidopsis thaliana; identical to SEQ ID NO: 244
  misc_feature (1)..(999): Ceres Promoter construct YP0019 as found in Promoter Report #40

SEQ ID NO: 614 - DNA, 999 bp, Arabidopsis thaliana; identical to SEQ ID NO: 252
  misc_feature (1)..(999): Ceres Promoter construct YP0087 as found in Promoter Report #42

SEQ ID NO: 615 - DNA, 990 bp, Arabidopsis thaliana; identical to SEQ ID NO: 256
  misc_feature (1)..(990): Ceres Promoter construct YP0180 as found in Promoter Report #43

SEQ ID NO: 616 - DNA, 999 bp, Arabidopsis thaliana; identical to SEQ ID NO: 260
  misc_feature (1)..(999): Ceres Promoter construct YP0186 as found in Promoter Report #44

SEQ ID NO: 617 - DNA, 996 bp, Arabidopsis thaliana; identical to SEQ ID NO: 264
  misc_feature (1)..(996): Ceres Promoter construct YP0121 as found in Promoter Report #45

SEQ ID NO: 618 - DNA, 999 bp, Arabidopsis thaliana; identical to SEQ ID NO: 268
  misc_feature (1)..(999): Ceres Promoter construct YP0096 as found in Promoter Report #46

SEQ ID NO: 619 - DNA, 999 bp, Arabidopsis thaliana; identical to SEQ ID NO: 272
  misc_feature (1)..(999): Ceres Promoter construct YP0098 as found in Promoter Report #47

SEQ ID NO: 620 - DNA, 999 bp, Arabidopsis thaliana; identical to SEQ ID NO: 276
  misc_feature (1)..(999): Ceres Promoter construct YP0108 as found in Promoter Report #48

SEQ ID NO: 621 - DNA, 999 bp, Arabidopsis thaliana; identical to SEQ ID NO: 280
  misc_feature (1)..(999): Ceres Promoter construct YP0134 as found in Promoter Report #49

SEQ ID NO: 622 - DNA, 999 bp, Arabidopsis thaliana; identical to SEQ ID NO: 288
  misc_feature (1)..(999): Ceres Promoter construct YP0138 as found in Promoter Report #50

SEQ ID NO: 623 - DNA, 999 bp, Arabidopsis thaliana; identical to SEQ ID NO: 296
  misc_feature (1)..(999): Ceres Promoter construct YP0192 as found in Promoter Report #52

SEQ ID NO: 624 - DNA, 999 bp, Arabidopsis thaliana; identical to SEQ ID NO: 300
  misc_feature (1)..(999): Ceres Promoter construct YP0204 as found in Promoter Report #53

SEQ ID NO: 625 - DNA, 1823 bp, Arabidopsis thaliana; identical to SEQ ID NO: 488
  misc_feature (1)..(1823): Ceres Promoter construct BIN2A2/28716-HY2 as found in Promoter Report #54

SEQ ID NO: 626 - DNA, 1539 bp, Arabidopsis thaliana; identical to SEQ ID NO: 489
  misc_feature (1)..(1539): Ceres Promoter construct BINA1-34414-HY2 as found in Promoter Report #55

SEQ ID NO: 627 - DNA, 1954 bp, Arabidopsis thaliana; identical to SEQ ID NO: 490
  misc_feature (1)..(1954): Ceres Promoter construct CR13 (GFP-ER)/ CR14 (H-YFP) as found in Promoter Report #56

SEQ ID NO: 628 - DNA, 1694 bp, Arabidopsis thaliana
  misc_feature (1)..(1694): Ceres Promoter construct 326D is a shortened version of Ceres Promoter construct CR13 (GFP-ER)/CR14(H-YP) as found in Promoter Report #56
gatcggccgtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacggcct

SEQ ID NO: 629 - DNA, 2001 bp, Arabidopsis thaliana
  misc_feature (1)..(2001): Ceres Promoter construct BIN1A1/15529-HY1 as found in Promoter Report #57
ctttgtcattgatggctcatgaaaagcaagaaatctgcgattgaattttaaactgcttcaatgttccttcagtacatggtaaaagagtataagaagaaggatgtacatatgatgtctttgttttctggtttgcaactttcaggttccatttgagtctatggttcatcaagtgcgagaagagctaaaaacaatagcgaagggtgattacaagccaccttcggagaaaagaaaacacgggtctattgttttcgctgccatcaacttgcctgctactcaagttcacagtcttcttgaaaaggtaaccaaccaatttcttatactatcatataaaaaaacaaaaggaatattgagacaagaactcttcaactgccgaaaactaaaggttaagtatgggctttgttattaattaatagatgttattctcatcagttggctgcagcaaacccaacaatgagatcttttctagagggaaagaaaaagagcatacaggaaaaacttgaacggtctcacgtgacgctcgcccacaagagaagccatggcgtagcaactgtagccagctatagtcagcacttgaacagagaggtacccgtagagctcaccgagctcatctacaacgacaagatggctgctctaacagcccatgttggatctgtggacggagagaccgtagtctccaagaacgaatggccacatgttacattgtggacagcggaaggcgttactgcgaaagaggccaacacgttacctcagctttacttagaaggaaaggcgagccgcttggtgatagatcctccggtgtcaatctcaggtcctctggagtttttctgaatacttgattaaacatggaagtttctctcttgagggaggttgctcgtggaatgggacacatatggttgttataataaaccattccattgtcatgagattttgaggttaatatatactttacttgttcattattttatttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagcgcgcttagctcagatgatagagcaccacaatttttgtggtgagaaatcggtttgactccgatagcggctttttactatgattgttttgtgttaaagatgattttcataatggttatatatgtctactgttttttattgattcaatatttgattgttcttttttttgcagatttgttgacagtctctaacc

SEQ ID NO: 630 - DNA, 1324 bp, Arabidopsis thaliana
  misc_feature (1)..(1324): Ceres Promoter construct p15529D is a shortened version of Ceres Promoter construct BIN1A1/15529-HY1 as found in Promoter Report #57.
gatcggccctttgtcttgatggctcatgaaaagcaagaaatctgcgattgaattttaaactgcttcaatgttccttcagtacatggtaaaagagtataagaagaaggatgtacatatgatgtctttgttttctggtttgcaactttcaggttccatttgagtctatggttcatcaagtgcgagaagagctaaaaacaatagcgaagggtgattacaagccaccttcggagaaaagaaaacacgggtctattgttttcgctgccatcaacttgcctgctactcaagttcacagtcttcttgaaaaggtaaccaaccaatttcttatactatcatataaaaaaacaaaaggaatattgagacaagaactcttcaactgccgaaaactaaaggttaagtatgggctttgttattaattaatagatgttattctcatcagttggctgcagcaaacccaacaatgagatcttttctagagggaaagaaaaagagcatacaggaaaaacttgaacggtctcacgtgacgctcgcccacaagagaagccatggcgtagcaactgtagccagctatagtcagcacttgaacagagaggtacccgtagagctcaccgagctcatctacaacgacaagatggctgctctaacagcccatgttggatctgtggacggagagaccgtagtctccaagaacgaatggccacatgttacattgtggacagcggaaggcgttactgcgaaagaggccaacacgttacctcagctttacttagaaggaaaggcgagccgcttggtgatagatcctccggtgtcaatctcaggtcctctggagtttttctgaatacttgattaaacatggaagtttctctcttgagggaggttgctcgtggaatgggacacatatggttgttataataaaccattccattgtcatgagattttgaggttaatatatactttacttgttcattattttatttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgggcct

SEQ ID NO: 631 - DNA, 1511 bp, Arabidopsis thaliana
  misc_feature (1)..(1511): Ceres Promoter construct p13879.CRS as found in Promoter Report #91
ttcaatttcttgtttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttca

SEQ ID NO: 632 - DNA, 1408 bp, Arabidopsis thaliana
  misc_feature (1)..(1408): Ceres Promoter construct p13879D is a shortened version of Ceres Promoter construct p13879.CRS as found in Promoter Report #91.
gacgcaggcccgatcggccgtgtgagttggtagcgaattaacggaaagtctaagtcaagattttttaaaaagaaatttatgtgtgaaaagaagccgttgtgtatatttatataatttagaaaatgtttcatcattttattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactacggcctgcagggccaatctc

SEQ ID NO: 633 - DNA, 2016 bp, Arabidopsis thaliana
  misc_feature (1)..(2016): Ceres Promoter construct CRS355 32449::HYFP/CRS311 32449::GFP-no tag fusion/BIN1A1/32449-HY1 as found in Promoter Report #92.
gatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaggcct

SEQ ID NO: 634 - DNA, 1960 bp, Arabidopsis thaliana
  misc_feature (1)..(1960): Ceres Promoter construct p32449D is a shortened version of Ceres Promoter construct CRS355 32449::HYFP/CRS311 32449::GFP-no tag fusion/BIN1A1/32449- HY1 as found in Promoter Report #92.
gacgcaggcccgatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgggcctgcagggccaatctc

SEQ ID NO: 635 - DNA, 19 bp, Artificial Sequence
  Synthetic Oligo(dtV)18 primer
ttttttttttttttttttv

SEQ ID NO: 636 - DNA, 930 bp, Arabidopsis thaliana; identical to SEQ ID NO: 509

SEQ ID NO: 637 - DNA, 86 bp, Arabidopsis thaliana; identical to SEQ ID NO: 510

SEQ ID NO: 638 - DNA, 949 bp, Arabidopsis thaliana; identical to SEQ ID NO: 4

SEQ ID NO: 639 - protein, 195 aa, Arabidopsis thaliana; identical to SEQ ID NO: 5

SEQ ID NO: 640 - DNA, 963 bp, Arabidopsis thaliana; identical to SEQ ID NO: 6

SEQ ID NO: 641 - DNA, 1627 bp, Arabidopsis thaliana; identical to SEQ ID NO: 7

SEQ ID NO: 642 - protein, 413 aa, Arabidopsis thaliana; identical to SEQ ID NO: 8

SEQ ID NO: 643 - DNA, 950 bp, Arabidopsis thaliana; identical to SEQ ID NO: 9

SEQ ID NO: 644 - DNA, 2310 bp, Arabidopsis thaliana; identical to SEQ ID NO: 10

SEQ ID NO: 645 - protein, 599 aa, Arabidopsis thaliana; identical to SEQ ID NO: 11

SEQ ID NO: 646 - DNA, 950 bp, Arabidopsis thaliana; identical to SEQ ID NO: 12

SEQ ID NO: 647 - DNA, 1538 bp, Arabidopsis thaliana; identical to SEQ ID NO: 13

SEQ ID NO: 648 - protein, 406 aa, Arabidopsis thaliana; identical to SEQ ID NO: 14

SEQ ID NO: 649 - DNA, 950 bp, Arabidopsis thaliana; identical to SEQ ID NO: 15

SEQ ID NO: 650 - DNA, 1720 bp, Arabidopsis thaliana; identical to SEQ ID NO: 16

SEQ ID NO: 651 - protein, 500 aa, Arabidopsis thaliana; identical to SEQ ID NO: 17

SEQ ID NO: 652 - DNA, 950 bp, Arabidopsis thaliana; identical to SEQ ID NO: 18

SEQ ID NO: 653 - DNA, 1193 bp, Arabidopsis thaliana; identical to SEQ ID NO: 19

SEQ ID NO: 654 - protein, 231 aa, Arabidopsis thaliana; identical to SEQ ID NO: 527

SEQ ID NO: 655 - DNA, 950 bp, Arabidopsis thaliana; identical to SEQ ID NO: 21

SEQ ID NO: 656 - DNA, 995 bp, Arabidopsis thaliana; identical to SEQ ID NO: 22

SEQ ID NO: 657 - protein, 236 aa, Arabidopsis thaliana; identical to SEQ ID NO: 23

SEQ ID NO: 658 - DNA, 950 bp, Arabidopsis thaliana; identical to SEQ ID NO: 531

SEQ ID NO: 659 - DNA, 124 bp, Arabidopsis thaliana; identical to SEQ ID NO: 532

SEQ ID NO: 660 - DNA, 1685 bp, Arabidopsis thaliana; identical to SEQ ID NO: 25

SEQ ID NO: 661 - protein, 468 aa, Arabidopsis thaliana; identical to SEQ ID NO: 26

SEQ ID NO: 662 - DNA, 950 bp, Arabidopsis thaliana; identical to SEQ ID NO: 27

SEQ ID NO: 663 - DNA, 2828 bp, Arabidopsis thaliana; identical to SEQ ID NO: 28

SEQ ID NO: 664 - protein, 824 aa, Arabidopsis thaliana; identical to SEQ ID NO: 29

SEQ ID NO: 665 - DNA, 950 bp, Arabidopsis thaliana; identical to SEQ ID NO: 538

SEQ ID NO: 666 - DNA, 104 bp, Arabidopsis thaliana; identical to SEQ ID NO: 539

SEQ ID NO: 667 - DNA, 1521 bp, Arabidopsis thaliana; identical to SEQ ID NO: 31

SEQ ID NO: 668 - protein, 392 aa, Arabidopsis thaliana; identical to SEQ ID NO: 32

SEQ ID NO: 669 - DNA, 950 bp, Arabidopsis thaliana; identical to SEQ ID NO: 542

SEQ ID NO: 670 - DNA, 19 bp, Arabidopsis thaliana
caaagaaaacatcaaaatg

SEQ ID NO: 671 - DNA, 700 bp, Arabidopsis thaliana; identical to SEQ ID NO: 34

SEQ ID NO: 672 - protein, 152 aa, Arabidopsis thaliana; identical to SEQ ID NO: 35

SEQ ID NO: 673 - DNA, 947 bp, Arabidopsis thaliana; identical to SEQ ID NO: 545

SEQ ID NO: 674 - DNA, 53 bp, Arabidopsis thaliana; identical to SEQ ID NO: 546

SEQ ID NO: 675 - DNA, 1218 bp, Arabidopsis thaliana; identical to SEQ ID NO: 37

SEQ ID NO: 676 - protein, 305 aa, Arabidopsis thaliana; identical to SEQ ID NO: 38

SEQ ID NO: 677 - DNA, 950 bp, Arabidopsis thaliana; identical to SEQ ID NO: 39

SEQ ID NO: 678 - DNA, 837 bp, Arabidopsis thaliana; identical to SEQ ID NO: 40

SEQ ID NO: 679 - protein, 278 aa, Arabidopsis thaliana; identical to SEQ ID NO: 41

SEQ ID NO: 680 - DNA, 950 bp, Arabidopsis thaliana; identical to SEQ ID NO: 42

SEQ ID NO: 681 - DNA, 1747 bp, Arabidopsis thaliana; identical to SEQ ID NO: 43

SEQ ID NO: 682 - protein, 514 aa, Arabidopsis thaliana; identical to SEQ ID NO: 44

SEQ ID NO: 683 - DNA, 950 bp, Arabidopsis thaliana; identical to SEQ ID NO: 45

SEQ ID NO: 684 - DNA, 3048 bp, Arabidopsis thaliana; identical to SEQ ID NO: 46

SEQ ID NO: 685 - protein, 1015 aa, Arabidopsis thaliana; identical to SEQ ID NO: 47

SEQ ID NO: 686 - DNA, 960 bp, Arabidopsis thaliana; identical to SEQ ID NO: 48

SEQ ID NO: 687 - DNA, 1194 bp, Arabidopsis thaliana; identical to SEQ ID NO: 49

SEQ ID NO: 688 - protein, 239 aa, Arabidopsis thaliana; identical to SEQ ID NO: 50

SEQ ID NO: 689 - DNA, 950 bp, Arabidopsis thaliana; identical to SEQ ID NO: 51

SEQ ID NO: 690 - DNA, 918 bp, Arabidopsis thaliana; identical to SEQ ID NO: 52

SEQ ID NO: 691 - protein, 305 aa, Arabidopsis thaliana; identical to SEQ ID NO: 53

SEQ ID NO: 692 - DNA, 950 bp, Arabidopsis thaliana; identical to SEQ ID NO: 564

SEQ ID NO: 693 - DNA, 153 bp, Arabidopsis thaliana; identical to SEQ ID NO: 565

SEQ ID NO: 694 - DNA, 2017 bp, Arabidopsis thaliana; identical to SEQ ID NO: 55

SEQ ID NO: 695 - protein, 339 aa, Arabidopsis thaliana; identical to SEQ ID NO: 56

SEQ ID NO: 696 - DNA, 950 bp, Arabidopsis thaliana; identical to SEQ ID NO: 57

SEQ ID NO: 697 - DNA, 703 bp, Arabidopsis thaliana; identical to SEQ ID NO: 58

SEQ ID NO: 698 - protein, 157 aa, Arabidopsis thaliana; identical to SEQ ID NO: 59

SEQ ID NO: 699 - DNA, 2039 bp, Arabidopsis thaliana; identical to SEQ ID NO: 61
  misc_feature: T1 Mature Plant Expression:  GFP expression observed in Sepal (Se), Receptacle (Re), Pedicel (Pd) in the upper part of the receptacle of the flower
  misc_feature: T2 Mature Plant Expression:  GFP expression observed in Pedicel (Pd) and Stem (Sm) in the inflorescence meristem, Epidermis (Ep), Pedicel (Pd) and Stem (Sm) in the pedicel junction of the stem, the flower
  misc_feature: T3 Seedling Expression:  GFP expression observed in the junction of the Cotyledons (Co), the Cotyledons and the Hypocotyl (Hy), the vasculature of the root, the Epidermis of the root tip
  misc_feature (1)..(2039): Ceres Promoter construct YP0001 as found in Promoter Report #1
  misc_feature (2023)..(2023): n is a, c, t, g, unknown, or other

SEQ ID NO: 700 - DNA, 1129 bp, Arabidopsis thaliana; identical to SEQ ID NO: 157
  misc_feature: T1 Mature Plant Expression:  GFP expression observed in the Endosperm (En) and Inner integument (Ii) of the fertilized Ovule (Ov), T2 Mature Plant Expression, T2 Mature tissue expressions similar to T1 expression data
  misc_feature: T1 Mature Plant Expression:  the Inner Integument (Ii) of developing ovules at approximately late heart stage embryo, the Endothelium (Ed) which is derived from the inner integuments during the seed maturation stage
  misc_feature: T2 Seedling Expression:  GFP expression observed in the root transition zone of the Root (Rt)., Atrichoblast (At) within the root differentiation zone of the root., T3 Seedling Expression, cotyledons
  misc_feature (1)..(1129): Ceres Promoter construct YP0007 as found in Promoter Report #2

SEQ ID NO: 701 - DNA, 1035 bp, Arabidopsis thaliana
  misc_feature: T1 Mature Plant Expression:  GFP expression observed in the Vascular (Vs) of the leaf
  misc_feature: T3 Seedling Expression:  GFP expression observed in the Epidermis of the Hypocotyl (Hy), the Vasculature (Vs)  of the root, the root tip and lateral root tip
  misc_feature (1)..(1035): Ceres Promoter construct G0013 as found in Promoter Report #3
atcttgtgatacacaatttattactatttggtacattttgaagtatttgtttttgcatgatatatgacgttaatttgaactgatattagtcaatttatgggtacaaaagttgaaagtttagagcactatgttggatttattaaaaatgatatcatacaatggttcaatatatatatatttttttccacgtttttaataacatttttgtaaacaagtcttctactattgtctttattgttaatgagtttctagtacctaattaggaattttgaggatatacgatacattaatgagttacattatcccgaaaacaaaatcttgaaaacgaacaaagataatttggacattactcgttatgtatacgtatggaattggatagagccgttgaaccatcaagtgggtcttcaagtcaacgaactgaatttgattttacactcatgtacatcggccacaattttattcacacactactaacacctctggtgtccacttttttctttctctagattgatgtgttaagatttttgttgcaattcatttattcaggtatttttatatatatatatatataaattagaataaactaatttaaagaaagatatagcaattatgtttcacattttaacattctcaatcatttataaaactaatgtggtgatgaatggtatatatatatatatatatatatatatatacatatatatattttgttgtgaactaatggtaaatatttaaaataagacatacgtacataaatccacgggctcttaaagtcatgatgcggttaataaatgttcacataacggtaaccaagtggctcaaaatcatgaaacaacgtcacataatttatcttataatgtggataattagtaccgcattatttgtaagaaaattaaattaattatagattcacagctaagaaaatacgaaaagacagctcaacacttttccacttctattccccactgtctatataactctgataaataatctctgatctctccaccattgcactggtccaggagataaacaaga

SEQ ID NO: 702 - DNA, 1000 bp, Arabidopsis thaliana; identical to SEQ ID NO: 442
  misc_feature: T1 Mature Plant Expression:  GFP expression observed in the Embryo (Em) and Suspensor (Su) of the four day embryo, the globular Embryo (Em), the heart stage embryo and the torpedo stage embryo
  misc_feature: T1 Mature Plant Expression:  GFP expression observed in the Embryo (Em) and Outer Integument (Oi) of the ovule, the Funiculus (Fn) and Placenta (Pl) of the ovary
  misc_feature: T2 Seedling Expression:  GFP expression observed in the Epidermis (Ep) of the hypocotylin the Cotyledon (Co), the Stipules (Ss), the lateral root initial, the lateral root cap
  misc_feature (1)..(1000): Ceres Promoter construct YP0097 as found in Promoter Report #4

SEQ ID NO: 703 - DNA, 1068 bp, Arabidopsis thaliana; identical to SEQ ID NO: 285
  misc_feature: T1 Mature Plant Expression:  GFP expression observed in the Endosperm (En) and Seed Coat (Sc) of ovules
  misc_feature: T2 Seedling Expression:  GFP expression observed in the Endodermis (Ed), Epidermis (Ep), Lateral root primordium (Lr) of the root, the Pericycle (EP, PE) of the Stele (St)
  misc_feature: T2 Mature Plant Expression:  GFP expression observed in T2 Mature tissue expressions similar to T1 expression data ., the Inner Integument (Ii) of developing seed, the maturing seed
  misc_feature (1)..(1068): Ceres Promoter construct YP0111 as found in Promoter Report #5

SEQ ID NO: 704 - DNA, 1002 bp, Arabidopsis thaliana
  misc_feature: T1 Mature Plant Expression:  GFP expression observed in the Pedicel (Pd) of the inflorescence meristem, the stem
  misc_feature: T2 Seedling Expression:  GFP expression observed in the Epidermis (Ep) of the hypocotyl, the Epidermis (Ep) of the cotyledon petiole, the Epidermis (Ep) and Cortex (Cr) of the hypocotyl
  misc_feature (1)..(1002): Ceres Promoter construct YP0104 as found in Promoter Report #6
tttattttattttttgaatgaaaatgtcttctttattcgtaattttaaactcactggtggtggatatattgttatgtccccaattcgtctggcaactctcgtatattagtgagaaaaatttgtccattatttactgcactattaccctgtgttaattttttgtattgaaattgtttttttagtaattcacgtcatatagcgaatgattctttaattttaaaaattcagtcttaagtttacaaattaaataacgctactgtaaccaactctgtacgaccaacatgttcgagtttttgtatatacggccatatatgtacatattttactataaagcgaaaaaatccataaattatttaattaatatataaaggtgccattctatttccaatgtgcttaggaaaatgcagaacctcgtgctatatctctgtcgccacgtgcaaatataacaatatgaaatagaactagcaaatcttgaaatctaactcttaagactaattcaagcacatacgtagagaaagttgaccaacggttatcagcattttaacatggaccttatcaacattttaacaaagtccacaaacaaccagtcttacaatcgcattggtacaagataatcgaattcatcttccatataacaaaacctaaaccttggtgtgaaaaggagaagatatgtatgttaaaggccgcctatgcctctggtttggggtatatgattctaagattagggtttgaatattttcgttagcctgccatgagatatatttatgtgataatttagagcctcttatgcattaatgcataaccgactagatccatgtggtattcagctaatcagtacacacaagacaaagtagtaaatgagtttgatgaagactgtggtctgataattcctatcaacgttaaatctgtcggggccaggcagccagcaacattttgcctaccaacgctctgaattcaattgaacctaggctatataatagcaggctaacttaactaagagtt

SEQ ID NO: 705 - DNA, 1000 bp, Arabidopsis thaliana; identical to SEQ ID NO: 341
  misc_feature: T1 Mature Plant Expression:  GFP expression observed in the Guard cell (Gc) and Vasculature (Vs) of the petal and sepal in the flower, the Lateral vasculature (Lv) and Medial vasculature (Mv), of the silique, the Guard cell (Gc) of the pedicel
  misc_feature: T2 Seedling Expression:  GFP expression observed in the Guard cell (Gc), that define the Stomata (So) of the cotyledon
  misc_feature: T2 Mature Plant Expression:  GFP expression observed in previous generation., T2 Mature tissue expression (if different expression pattern)., the Epidermis (Ep), Guard Cells (Gc) and  Vasculature (Vs) of the proximal
  misc_feature: T2 Mature Plant Expression:  GFP expression observed in mid and distal siliques, the Epidermis (Ep) and Guard cells (Gc) of the mid region of the siliques and the stem
  misc_feature: T3 Seedling Expression:  GFP expression observed in T2 Mature tissue expression (if different expression pattern).
  misc_feature (1)..(1000): Ceres Promoter construct YP0075 as found in Promoter Report #7

SEQ ID NO: 706 - DNA, 998 bp, Arabidopsis thaliana
  misc_feature: T1 Mature Plant Expression:  GFP expression observed in the Receptacle (Re) and Vasculature (Vs) of the flower, the Phloem (Ph) of the leaf
  misc_feature: T2 Seedling Expression:  GFP expression observed in the Phloem (Ph) of the root differentiation zone
  misc_feature: T2 Mature Plant Expression:  GFP expression observed in similiar tissues to T1 mature expression data plus the hydathode region of mature leaves.
  misc_feature: T2 Mature Plant Expression:  Hydathode is a highly modified region of vascular and ground tissue that permits release of water through a pore in the epidermis.
  misc_feature: T3 Seedling Expression:  GFP expression observed in T3 Seedling tissue expressions similar to T2 seedling expression plus, the Epidermis (Ep) of the root transition zone of the hypocotyl
  misc_feature: T3 Seedling Expression:  GFP expression observed in the Vasculature (Vs) of the root, the Hydathode (Hd) and Vasculature (Vs) of the root
  misc_feature (1)..(998): Ceres Promoter construct YP0016 as found in Promoter Report #8
aaacatgttttatgtaactactttgcttatgtgattgcctgaggatactattattctctgtctttattctcttcacaccacatttaaatagtttaagagcatataaattaattatcttcaaaaaggtgattatatgcatgcaaaatagcacaccatttatgtttatattttcgaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcct

SEQ ID NO: 707 - DNA, 1000 bp, Arabidopsis thaliana; identical to SEQ ID NO: 411
  misc_feature: T1 Mature Plant Expression:  GFP expression observed in Chalaza (Ch), developing floral buds (numbered), Embryo (Em), Inflorescence meristem (Im), Micropyle (Mp), and Phloem (Ph)
  misc_feature: T2 Seedling Expression:  GFP expression observed in Cortex (Cr), Cotyledon (Co), Epidermis (Ep), Hypocotyl (Hy), Lateral root (Lr), Pericycle (Pr), Rosette leaf (Rl), Phloem (Ph), Vascular bundle (Vb).
  misc_feature: T3 Seedling Expression:  GFP expression observed in Root vasculature
  misc_feature (1)..(1000): Ceres Promoter construct YP0094 as found in Promoter Report #9

SEQ ID NO: 708 - DNA, 691 bp, Arabidopsis thaliana
  misc_feature: T2 Mature Plant Expression:  GFP expression observed in the Vasculature (Vs) of the sepal of the flower, the Guard cell (Gc) of the pedicel, the Guard cell (Gc) of the silique
  misc_feature: T3 Seedling Expression:  GFP expression observed in the Guard cells (Gc) of the leaf, the Root hair (Rh) and Epidermis (Ep) of the root transition zone between hypocotyl and root, the Atrichoblast (At) and Trichoblast (Tr) of the root
  misc_feature (1)..(691): Ceres Promoter construct YP0033 as found in Promoter Report #10
gtcgattggaacttccaatttctaaacggatgcaataagaacttacatattctctttcattagtcatttattggccagatttattaaaaaaagttttactcaatgaccaaggattagagttaaagataatatagattattacatatattattcgaaaaaatatacccatgtccgactttttaaacctcaaaaatatcaaaaccagaaaagatgatacaacacaaaaaaacaataaaataataagtggaagagatatcatcggacaacagtacaagtacagcaccagctctgccaaaagccaaaaccatttgtcaattacagaaagatactaatgtttgaaattactaaattacccctcggactttacaaaagcatctctaacttatccacgtgtcagtcatctattgattgtttcaataccaccttgtattaacgccccacgattcgtggttgggtacacctgatagtccgaggatatttaaatctcacgcgctcgtgtctataattcgactgtactcgcttttcttgtcgtgattttagcaatttacgaagtcaaatgtttgactcaatcagacttgcgcataggagagcgagtataaatgtttactatactcacgcaagtggggctttattgaaactactcttttgtaataaaaccagcagtggttttgttctgaatccgctctcttgc

SEQ ID NO: 709 - DNA, 992 bp, Arabidopsis thaliana; identical to SEQ ID NO: 97
  misc_feature: T1 Mature Plant Expression:  GFP expression observed in the Sepal (Se) and Pedicel (Pd) of the flower, the Epidermis (Ep) and Phloem (Ph) of the sepal, the Epidermis (Ep) and Phloem (Ph) of the petal
  misc_feature: T3 Seedling Expression:  GFP expression observed in the Phloem (Ph) and Epidermis (Ep) of the hypocotyl, the Phloem (Ph) of the root transition zone of the hypocotyl, the Guard cells (Gc) of the primary leaf
  misc_feature: T3 Seedling Expression:  GFP expression observed in the Phloem (Ph) and Epidermis (Ep) of the Cotyledon (Co), the Phloem (Ph) of the root elongation zone and root differentiation zone
  misc_feature: T2 Mature Plant Expression:  GFP expression observed in T2 Mature tissue expressions similar to T1 expression data ., the Vasculature (Vs) of the stem
  misc_feature (1)..(992): Ceres Promoter construct YP0049 as found in Promoter Report #11

SEQ ID NO: 710 - DNA, 1000 bp, Arabidopsis thaliana
  misc_feature: T2 Mature Plant Expression:  GFP expression observed in the Guard Cells (Gc) and Vasculature (Vs) of the sepals of the flower, the Vasculature (Vs) of the Pedicel (Pd), the Vasculature (Vs) of the petiole
  misc_feature: T3 Seedling Expression:  GFP expression observed in the Guard Cells (Gc) and Vascular (Vs) tissue of the Cotyledon (Co), the Phloem (Ph) of the petiole, the Vascular (Vs) tissue of the primary leaf, the Root hair (Rh) of the root transition zone
  misc_feature (1)..(1000): Ceres Promoter construct YP0060 as found in Promoter Report #12
tggagctttattgaaatgcaagaaagtaaacaaaggaagatctttagattgtcaccaagagtggtctgaaactctcataacactcaatcctcctcctcctcatcaccaccactacaaaatattatattctctatctctcaatctatgaggagatgtattctatcaagcatttgaaatgataagaaactggcgatcatcctctacgtcaccatcactccaaaattatcctctttctaggtttaagttttgtaatgatcgcctttatttgttgagatctctaacttctcgcatttccaaaatgttaagtccaataactgcattggttaagttggggcgttactagtcggcttaaatccaaatatggatttgattccatatgtatgtgacagtttcttaacgttcatattacaatgaatgatggatccttgactagacaaagagaaaatggattgtcacttcgtaggaaaaatagaaattctccacgaaggctggtctcctttatttaacgacaaattcactcatagtctcattcacaatttgaacttgtctaacacaatgtgttatatactcgcgaaaagaagcataataggctcttaagggtaatccacgaaaccaaaacacatataaaacattaatatttttctctaaatttattcatatcaataataaagtttacaaaaaatataaaacaataatccatacttagcccatagcttcgtgtggaagaagacttgatttttgactagtcaacgaaaatgagtaaatgacgtattcagctatagtaaaagggatcataagcggaaattacaaagaagctttgagggtaaactagtcaaaaagcataatcagaaataacttaggcccaaagcaaaaaggaaagggctctggatccagccgcaaatcagaatctggtaagttcgaacgccacgtcatcacctaaatatctgaaatatctaattaagacttgtctatatataaaggcttctcctttcacaatccc

SEQ ID NO: 711 - DNA, 1069 bp, Arabidopsis thaliana
  misc_feature: T2 Mature Plant Expression:  GFP expression observed in the endothelium layer surrounding the embryo of mature ovules. Inner integument cell layers can, the Inner integument (Ii)
  misc_feature: T3 Seedling Expression:  GFP expression observed in
  misc_feature (1)..(1069): Ceres Promoter construct YP0092 as found in Promoter Report #13
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagccccagacataacaaaattagacttgtcgtacatctttaatatttttttatctgtttctttgtcctgacgctttcattattcctgtgatcaattttctcataccattggtccatcgttaatcctttcttaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtaccattgcactgggatccaacaatgtcctccgactcgtccaagatcaagaggaagcggaaccgcatccc

SEQ ID NO: 712 - DNA, 1687 bp, Arabidopsis thaliana
  misc_feature: T1 Mature Plant Expression:  GFP expression observed in the Lateral vasculature (Lv) and Medial vasculature (Mv) of the silique
  misc_feature: T2 Mature Plant Expression:  GFP expression observed in T2 Mature tissue expressions similar to T1 expression data plus, the Medial vasculature (Mv) of the silique
  misc_feature (1)..(1687): Ceres Promoter construct YP0113 as found in Promoter Report #14
tatgaagaaattataatagactctcataaaaatagtgttacaacttacattctcttatatagaaattaggataaacagaaatgtaaataatatatttcgaaataatgttaaatttcctaaattctaatattaatatttataaatggtcatttaactttttcgtaccggttcgatgggacatgtgttatattcagttaaggttaccaccatgcgccaacttggcctctaccaagtcaacatggatatggaccttatggttacatgccgcctccgcctccaccgctaccgggatatggatacagaggtccgccacctcagcaaccgacgaggaatgaaacaaggcaataatatattgatgctattgtggatttagttactgataattagtgccttagtgacagttcaaaaatgttgttcatcaataatctacaatttaaggtttgtgttgtggaatgtttcatgattttatgaagtcttgcttatcaaaaagtatgatgattaagaatttgacttcatggcatattcatttgagttagcaaaacttttttgtgttgcaccttcaaatttataaatttatgatttttaaccatcgaaattatatatttgaaaagactatctctacaagccaaacccactgggccaccaatatgggtttatctgcgaaatctgtgaaccttagaaaatcaaagcccatatccactttgctggaactttgctggaatgtaggttagacaaaaccttaagacgcagctacaagtctcttatgtggcagatgtcaaaattaatgagcacgtataatttacccaagaggagcaaaataagattagcagcttaaattaattgtgttggattaaatgaaacttgcactatgaatggcaaaaaagaggttacaatctagcaaccacctcataaaccctcattaatgagatactgactcgtgaaccaatcaaatctcaagtttcgtagtttaaataagtagtaaacacctcctgatcaaagcatcaccaccaccaaatatcaaacgcaaaaacctattatcaaaagaactagggaggaaatgactaatccccatgatcatggttatgctgttgttgtttcttgtgatgtcgactagagcagacgaagagctgattaagacagagtgtaatcacacagaataccaaaacgtatgcctcttctgtcttgaagccgatcccaatctccttcaatatcggaccgtgctggacttgtcaaccatcattaatacactgtctcgggatctcaacttgatgttcttatcaagtaagtttcaccatgtacaccattaatcattattgtacaaataataatatttttaatgtgttttcacaaaattaatattacctcttttttgtaaactaatatgctacgaaaattaacatactacgaaaaatgtgaattaatattactttgcctgtaaatttttacctccataataatattagcataccacgaaaaaatgtaacgtatttcttttggtgtaatgtgaattttgctacggtaaacttactttacaaagaaagaagagcgttttccaagtggaaaataatacattttgcggtttatatattataggaacgactattgatttgtttttttggttgtaccattgcactgggatccaacaatgtcctccgactcgtccaagatcaagaggaagcggaaccgc

SEQ ID NO: 713 - DNA, 999 bp, Oryza sativa; identical to SEQ ID NO: 136
  misc_feature: T2 Mature Plant Expression:  GFP expression observed in the Guard cell (Gc), Lateral vasculature (Lv) and Medial vasculature (Mv) of the silique
  misc_feature (1)..(999): Ceres Promoter construct YP0095 as found in Promoter Report #15

SEQ ID NO: 714 - DNA, 1000 bp, Arabidopsis thaliana; identical to SEQ ID NO: 140
  misc_feature: T2 Mature Plant Expression:  GFP expression observed in the Female gametophyte (Fgm) of early pre-fertilized ovules, the Embryo sac (Es) of pre-fertilized ovules
  misc_feature: T3 Seedling Expression:  GFP expression observed in the Epidermis (Ep), Lateral root initial (Lri) and Root hair (Rh) of the hypocotyl-root, the Epidermis (Ep), Lateral root initial (Lri)
  misc_feature: T3 Seedling Expression:  GFP expression observed in Pericycle (Pr) of the lateral root initial, the root epidermis, the Pericycle (Pr) of the lateral root primordial, the Pericycle (Pr) of the lateral root
  misc_feature (1)..(1000): Ceres Promoter construct YP0102 as found in Promoter Report #16

SEQ ID NO: 715 - DNA, 1004 bp, Arabidopsis thaliana
  misc_feature: T1 Mature Plant Expression:  GFP expression observed in the Female gametophyte (Fgm), Inner integument (Ii), and the Micropyle (Mp) in the pre-fertilized ovule, the Inner integument (Ii) of the fertilized ovule
  misc_feature: T2 Mature Plant Expression:  GFP expression observed in T2 Mature tissue expression (if different expression pattern)., the outer integument(Oi) of the developing ovules, the seed coat (Sc) of the developing seed
  misc_feature: T3 Seedling Expression:  GFP expression observed in root hairs.
  misc_feature (1)..(1004): Ceres Promoter construct YP0103 as found in Promoter Report #17
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgtttttacaccatgcacgtgttatctaacaaagaaaatatggtacacctaatggctaatgcaaaggacaacacaatgaaactaacttgactctgtgttatagaaacccatagacatctgcatacatcctagtatttgtataaattggactcaaattcctgaggacaatcatagcaaacaatcacatcatcgcaatatacataaacaaaagaggaagaaaaa

SEQ ID NO: 716 - DNA, 1003 bp, Arabidopsis thaliana
  misc_feature: T1 Mature Plant Expression:  GFP expression observed in the mature embryo, the Endosperm (En), the Endothelium (Ed)
  misc_feature: T2 Mature Plant Expression:  GFP expression observed in T2 Mature tissue expressions similar to T1 expression data., late torpedo stage of embryo
  misc_feature (1)..(1003): Ceres Promoter construct YP0107 as found in Promoter Report #18
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatctattttagactatttgggccttaactaaacttccactccattatttactgaggttagagaatagacttgcgaataaacacattccccgagaaatactcatgatcccataattagtcggagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 717 - DNA, 1071 bp, Arabidopsis thaliana
  misc_feature: T2 Mature Plant Expression:  GFP expression observed in the Embryo sac (Es) of the pre-fertilized ovule, the Degenerated synergid cell (dSn) of the fertilized ovule
  misc_feature (1)..(1071): Ceres Promoter construct YP0110 as found in Promoter Report #19
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaactttgcgggtaccggttttgtctgctctaagaattagaatgttaatgagttctgtcttaccttccaccatagaaagtgtatggctcataaatagtagcaaggtgtttggcttgttcaacagatttcttgcatataaactttagcttctgcatcatcttactatccactgaactcataccactcatcaacccactccgttcttgagcatctctccacaaatgatccgagaaatcatcaacggaattgaaaagtttcatcaaacgcaccataataggatcacctttagagtccatgcatggagatgttttgtagtggttataaagaagctccgctaagtcttcgaaaaccagcgggtttatcgccgaagaagcgatctgatacacgtttatttcaggttccggatctgacattgccattccatgctttgctatagcagctaacgttcc

SEQ ID NO: 718 - DNA, 1453 bp, Arabidopsis thaliana
  misc_feature: T2 Mature Plant Expression:  GFP expression observed in the Medial vasculature (Mv), Lateral vasculature (Lv) and Guard cell (Gc) of the stigma, the Medial Guard cell (Gc) of the carpel
  misc_feature (1)..(1453): Ceres Promoter construct YP0112 as found in Promoter Report #20
ttatgtgccctgatgtcctatgcagatggtgcaactactgcttttggtgagaagcttcgcgaacaagttgaggaaaggctagaattttatgacaaaggtgttgccccacgcaagaacgtggatgtaatgaaggaggtgatagagaatctaaagcaaggtatttcttgtagctgtttttttttggttgtaatcagagtcctctttatgatggcaaactcagtgtttttttatctgttcctcctttagaagaggaagggaaggagccagttgatgcctcggtgaagaaaagcaagaagaagaaggcaaagggtgaagaagaagaagaggtggtggcaatggaggaggacaagtcagagaaaaagaagaagaaagagaagaggaagatggagactgcagaggagaacgagaaatcagagaagaagaagacaaagaagagtaaagctggaggagaagaggagactgatgatggtcacagcaccaagaagaagaagaagaagtctaagagcgctgaatagaaagggatgcaacattaacaaaccctgtattgtattttttttttgagctaaattaatgtcgtctgtttttcgtagtgaacatcggagaatttttgttttggtctggaaacgattcaaggtttggcaatatcttaagtttgtttaggttttcactattttgacgtttgcaaccgtgaaggaggctcctccattttataaaatacaattaccaattccagtgctttgcaaatgtttcaataatagctaaactaactaccaaattggaaaactagcttaacaagtttgtgaaaatgaatttggagccatatgatttattattttacccaaatggagtaatagaagaagagcagctcgcgtttgaatggtcagttaacattaacaaaaggtaaaattgaatagatgttaaaacttgtgtaagtaaacaatagagctacctccttttgagaaggatagataaactcgtgaccaaccacattcccagtcccatattcttagtacaaataagaaattcacacccctcaaaagaaatataacataatcaatcataggaaatatacttcgcataatgacgataatgatcaagtttctcctgttagctctgctcgtgatctctccgatttgcgccgagaaggacctgatgaaagaggaatgccataatgcacaagttccgaccatttgcatgcaatgtcttgaatccgacccaacctccgttcatgcagaccgtgttggcatcgccgagatcatcatacactgtctcgactctcgtctcgatatcatcaccaagcaagttttcccttctaataaccatacatatatattaacttagatatatgacaatattctctaactaatatatcaatctttttattgttctaccattgcactgggatccaacaatgtcctccgactcgtccaagatcaagaggaagcggaaccgc

SEQ ID NO: 719 - DNA, 1085 bp, Arabidopsis thaliana; identical to SEQ ID NO: 165
  misc_feature: T2 Mature Plant Expression:  GFP expression observed in the transmitting tract of the stigma, the Epidermis (Ep)
  misc_feature (1)..(1085): Ceres Promoter construct YP0116 as found in Promoter Report #21
  misc_feature (1065)..(1065): n is a, c, t, g, unknown, or other
  misc_feature (1082)..(1082): n is a, c, t, g, unknown, or other

SEQ ID NO: 720 - DNA, 1100 bp, Arabidopsis thaliana; identical to SEQ ID NO: 169
  misc_feature: T2 Mature Plant Expression:  GFP expression observed in the stem pedicel branch, the secondary Inflorescence meristem (Im), the Lateral vasculature (Lv) and Medial vasculature (Mv) of the silique
  misc_feature: T2 Mature Plant Expression:  GFP expression observed in the ovary, the Inner integument (Ii) and Micropyle (Mp) of the ovule
  misc_feature: T2 Seedling Expression:  GFP expression observed in the Cortex (Cr) of the hypocotyl, the Epidermis (Ep) and Cortex (Cr) of the lateral root, the Epidermis (Ep) and Cortex (Cr) of the root differentiation zone
  misc_feature: T3 Seedling Expression:  GFP expression observed in the Lateral root (Lr) of the hypocotyl root transition zone, the lateral root primordia, the Epidermis (Ep) and Vasculature (Vs) of the root
  misc_feature (1)..(1100): Ceres Promoter construct YP0117 as found in Promoter Report #22

SEQ ID NO: 721 - DNA, 1001 bp, Arabidopsis thaliana
  misc_feature: T1 Mature Plant Expression:  GFP expression observed in the Lateral vasculature (Lv) and Medial vasculature (Mv) of the carpels of the silique
  misc_feature (1)..(1001): Ceres Promoter construct YP0118 as found in Promoter Report #23
aattgagaaaggtgcctcaatttcagtagaacctgacgcaaaatttcgcgatcatgcatgactcaaattggtttattcacttaaataaaaaagttgtttccctatctagttgaagttctcaattcaaacgcaacttcttactttttctttttatttatactggaatgaatttttcgtcaatgctagacctcaatatttggtgattaagtccaaaaaattatagcaatattcattagttaaatcataataatatttgttatttctgctaaatatattagttttaaattggtaaatatatcagtcatcatactttatatatgtgcacaagaaaaagaggaaaaaaaactaacttttaataaattgaacgctatcctctatatctcgtcctggtccaaatgtaaacttcaatatccttttgattttattgctgattgctttaaaaaatttcacaaacacttttatcattcttttattccaccaaaatctacagacataatactttgtaattttatgtaaaaatcttcaaaatttgggaaaagaaaaatcatttaaaatcaatttgcattaactggatttatttccaaaggtgtggtgttgtgtttatatatgtggagttgttggctagtaatataataaggaaaagagtgaaacatatgtagtataacgtatttctagttttttttctctgtattaatgaatcactaattaagtagtatgcattaattgaattatcagaagctggtcacaaaagtctaccaaaaaaaacaaaaaaattggtcggaagaaaatgaaaataatgagaataaaaaagggaaaaaaaataagaagctagcaaacaaagcaattaacatttcaaggcagttaattcatcatgcaaggtgcttatgtgtgacaacgtcatgcgttactttttgcgtctacactcatctctctaacgcaatccactaattctggtaatggattctgctatttagaccaaccagtttcttcgtctctcaatc

SEQ ID NO: 722 - DNA, 1076 bp, Arabidopsis thaliana
  misc_feature: T1 Mature Plant Expression:  GFP expression observed in the Petal (Pe), Sepal (Se) and Silique (Si) of the flower, the Epidermis (Ep) and Vasculature (Vs) of the sepal
  misc_feature: T1 Mature Plant Expression:  GFP expression observed in the Epidermis (Ep) of the petal, the Mesophyll (Me), Epidermis (Ep) and Vasculature (Vs) of the leaf
  misc_feature: T2 Seedling Expression:  GFP expression observed in the Epidermis (Ep) of the hypocotyl, the Epidermis (Ep), Mesophyll (Me), Cytoskeletal (Cy), Epidermal bodies (Eb), Guard
  misc_feature (1)..(1076): Ceres Promoter construct YP0126 as found in Promoter Report #24
cattgtatctgagatgtgactgtgaagaacaaagattcatgacatggtattgttaagccgcccatgtggatgatcataaccaaactctgtcctcagatttactcaacagtgtgtgtgaaacaaaggctggtttaagtatgaaaccggcaccacatatctcttcttcttctgatcattctctcctacatagaccgccatgaatcctcttggtgtcgacgatgattcccttcgaataatttgcttagcacccaagaaactcctcaaaaaagccatattttcccttatgttttcctgaagcttaaatgtttcttagtcttggagaaagctttgagattttaaaattggatcttctttagtttgtgaatctaaaggggtttagttacttggtatataaacgaacgtatgaaagaaatgattaaggatttttgaggtttttctttttaattacagagcacatggctttgggttgtagatactaaaccaagaacaaatcaataaatggtgtctgagaagttagtgtctaatgatgtcctacatgataacttcattggggcttatttgtctcaaagacatcacatgcccaaatctctctatagattatgtagggacatgaagttgtgtacctaatgaaccacaagtctctatcactgattaagtcataccttcttctcaatgatattcaaaagacaggaccacatgatttgattatatactgacaaagtcacaaaagccttcaaaaaaattctgtggcaagaaaggaaaatttgactagttatagtgtctatctaacaaacaagtggtcatattgatttctatcttcacatcagaaatcatgaagattgatcactatagggcccttacttatcatgccgtggtccggcaaagccatgtgcttgcttgttggtgtaaaaatttatgagctgaaacttttgaaaccaataaagggttatctacaagtaatgttcttatctatatatactcatcactgactcctttctgctctgccattgcactgggatccaacaatgtcctccgactcgtccaagatcaagaggaagcggaaccgcatcccgctc

SEQ ID NO: 723 - DNA, 1017 bp, Arabidopsis thaliana
  misc_feature: T1 Mature Plant Expression:  GFP expression observed in the inflorescence meristem, the Vasculature (Vs) of the sepal, the stamen, the Micropyle (Mp), Funiculus (Fn), Inner integuement and Chalaza (Ch) of the ovule
  misc_feature: T2 Seedling Expression:  GFP expression observed in the Phloem (Ph) of the hypocotyl root(Rt) and Lateral root (Lr), the Phloem (Ph) of the root, the Phloem (Ph) of the lateral root, the Phloem (Ph) and Pericycle (Pr) of the lateral root initial
  misc_feature: T1 Mature plus:  GFP expression observed in the Vasculature (Vs) of the silique
  misc_feature: T3 Seedling Expression:  GFP expression observed in T2 Mature tissue expression (if different expression pattern)., the Epidermis (Ep) of the cotyledon, the Hydathode (Hy) of the rosette leaf
  misc_feature (1)..(1017): Ceres Promoter construct YP0127 as found in Promoter Report #25
tcagtgagtcgattggaacgtttaaagttgagacataacgcagtgatttcaaatttgtattagggtggtcttattgtgtgtctagctactagctagagaatactagaagaagaatacgtagcaagatacgcataacatttggtcctctcttttttttactttcttttaacacattgtcctcttatgatttgcttattgatttcagtatctttttgtatcaataattccctccaaatgattaaaccctaaaaaaatgtgattcattcaccacccgaagattagcatcatcaagtaacacacaataactaccaataacctagttttcatttttctatactaaaatcctaaacatcccataaaaatacaaacaactctgaaccaataatttcctctaatccacgtgcaccccatcgtctcctgacgtaagatttgtctataacttatcaaatcccaaattcagctttgttttcattatatagtacgtactcttataaaaaagagaagagtacacatctttaatactttaacttaaaagaagaaagtaatactaatataagaggagtctgagtcagcgacaagtgttcgcggagaaacggaaacgctctctttctctctcttcccccaacgccaatacctttggaatccctccctaactctgtcctgtcctttcgtcctcactttctctctttttacattttctacacaccaataaaattgaaaccagcaacttataaatcaactcaagtttgaattaatgatcgaaaaactagtttatttgtgtcaatatgacccattctttattcacataagtattttaacttttcaaaatgttatctcaatctcctttgagtttctgtcttccccataataaatttcaaataattaatacacatggttttttaattagaaataatggaaaagaaaggacaaaggaataaaaaagaaacacaagttggcacactctctttattattcactcccctctataaatctcatactatcttctctcatcttctt

SEQ ID NO: 724 - DNA, 1004 bp, Arabidopsis thaliana
  misc_feature: T1 Mature Plant Expression:  GFP expression observed in the vasculature (Lv) and Medial vasculature (Mv) of the silique
  misc_feature: T2 Seedling Expression:  GFP expression observed in the Epidermis (Ep) of the root transition zone of the hypocotyl, the Epidermis (Ep) of the root specialization zone
  misc_feature: T2 Seedling Expression:  GFP expression observed in the stipules, the Epidermis (Ep), Atrichoblast (At) and Trichoblast (Tr) of the root differentiation zone
  misc_feature: T3 Seedling Expression:  GFP expression observed in T2 Mature tissue expression (if different expression pattern)., the Epidermis (Ep) of the cotyledon, the Epidermis (Ep) and Hydathode (Hy)
  misc_feature (1)..(1004): Ceres Promoter construct YP0128 as found in Promoter Report #26
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcggtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 725 - DNA, 1081 bp, Arabidopsis thaliana
  misc_feature: T1 and T2 Mature, T2 and T3 Seedling Expression:  GFP expression observed in the Root Hair (Rh) of the hypocotyl, the Hydathode (Hd) of the cotyledon adaxial surface
  misc_feature: T1 and T2 Mature, T2 and T3 Seedling Expression:  GFP expression observed in the Epidermis (Ep), Mesophyll (Me) and Vascular (Vs) of the cotyledon, the Hydathode and Guard cells of the rosette leaf
  misc_feature: T3 Seedling Expression:  GFP expression observed in the Guard cell (Gc) of the flower, silique and pedicle, in the Guard cell (Gc) and Vasculature (Vs) of the leaf
  misc_feature (1)..(1081): Ceres Promoter construct YP0020 as found in Promoter Report #27
cagagcagtgcatatttttttttttttttttttggtgttagtgcatatctatatatatagtactattataatatatttcaatatatatattttaagaaaatatctgattcttaagtttggacttatttgtcaacaatagccagtaaaaaacaaaagcgaagtttcactaacttaaaaaataaccacatttgtatatttcgaatacatactataaattaataaatttatcaaaacaactatagaaactgttatttccaatcaatttctttatcaagattatatctgaaatatatttattaaaattaatagttatttacaagaactatttttatgaaagtgtaagaactctctgaaaacttgataagtcaatattttttctaacatcgtaaacataaactagattcaaattcgaatctagttattcaaaaacttataaaaacataaaaatgaaatactgttacttcaacaaaaaaacattattattattttgtttaaatatctaatttattcatcaacagcaaaatatttaaaagagtgggaaacaaataaaaattaaactctgttttggtatgataaaattatttactaaactaaactcaatatatttttagtatcacggttataactataacaataatcgaactttgttattttcttggtactggttttagtagtatagatagatattttagtcataactcataagatacatgtacaaatatttgctatatatgatcagtgataactgaatttcgtgctgaaaattgccatagtttgcttattttactcttgaaacaataacgatatggtcgttacttaaaacaacattttaaaaacgaagaaaattaaacagagtttgttaaaataaattaaataccataaatttctctttgactcttcctatatagtaaaatctctcatccccttctctctctctctcatagcatgttggtctttaggttcctatataaacaacgccacacacacccatttagtcccaccattgcactgggatccaacaatgtcctccgactcgtccaagatcaagaggaagcggaaccgcatcccgttaaacgaaggc

SEQ ID NO: 726 - DNA, 1091 bp, Arabidopsis thaliana
  misc_feature: T1 Mature Plant Expression:  GFP expression observed in the Vasculature (Vs) of the pre-fertilized and fertilized silique
  misc_feature: T3 Seedling Expression:  GFP expression observed in the Epidermis (Ep), Phloem (Ph) and Root hair (Rh) of the hypocotyl root zone, the Epidermis (Ep) and  Vasculature (Vs) of the petiole leaf
  misc_feature: T3 Seedling Expression:  GFP expression observed in the Epidermis (Ep), Phloem (Ph) and Vascular bundle (Vb) of the Cotyledon (Co), the Phloem (Ph) of the Lateral root (Lr) and lateral root initial, the Phloem (Ph) and Vascular bundle (Vb) of the Root
  misc_feature: T2 Mature Plant Expression:  GFP expression observed in the Vasculature (Vs) of the inflorescence meristem and silique, the Guard cell (Gc) of the pedicle, the Septum (Sp) of the silique
  misc_feature (1)..(1091): Ceres Promoter construct YP0022 as found in Promoter Report #28
tagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataagcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaaaaaaccaacttatatgagtaatagaaacgatcctcatattaggaattttagagattttctctcatctgtttcttaacttttcaatatttttatttttttaaattgtatgagtttctactaagaaactactgctggagttggtcttagcttcccaatgcttctccacctatatatatgcatatctccttcttaaaactccattgcactgggatccaacaatgtcctccgactcgtccaagatcaagaggaagcggaaccgcatcccttatactaaaggcgg

SEQ ID NO: 727 - DNA, 1082 bp, Arabidopsis thaliana
  misc_feature: T3 Seedling Expression:  GFP expression observed in the Root hair (Rh) of the hypoctyl root zone and the root, the Guard cells (Gc) of the leaf
  misc_feature: T2 Mature Plant Expression:  GFP expression observed in the flower and silique
  misc_feature (1)..(1082): Ceres Promoter construct YP0024 as found in Promoter Report #29
  misc_feature (1069)..(1069): n is a, c, t, g, unknown, or other
tgttaagggaaggtttgcacctaagaattttgaaggaattttgcggcgatatatcagtaagtaactttcttcttagtctcaaaatttaagttgccataaaagtatatcagtttggagttgttaacctcttgttttattatttctcagctgactacgtcatttgccttggttgcaagagcccagacaccattctctccaaggagaaccgtctcttctttctgagatgtgaaaaggtataagttaatctaattagtcctgatcttgatatgcattcctttgtttctgttttacagttttactttctgcgcaacaaagtaataaagtattttgtgtgtttgaatttgctaatgtgattaacgagtgggctacatggtttttgcagtgtggatctcaacgatctgtggctccgatcaaaacagggtttgttgctcgtgttagtcgcaggaagacttgagaaattagaaggtgaagtgaccttggtatggagtttggagctattctactgcttctgtatgagtttatgagttgaagaaatacttgtcttgttttttttattttgttttggaatatgattatgacttgacttttaaaatgggataggatcaaaaccttttactctgtcaggttcatgtggtcaccttgaaggttgatttagtaaatccatggacttcttttttgtgttaagattattcttagttcaaaattaatagactaatgatattaacgtccacaggcattgcgttcaacatctcaaattaaagcgtggaaggctcagaaagtccaatatacactatgtttatctacagttacaatcatactacaaaaaacaaataatgtatacggtttggtctaatatagccgcatacgatttagtatttaccaacaaaaaattggtctcaaaccaaaccgaacaattggtaattaacaattgttcttttggtcttgaaccgaaccaaaccgaactgaactatattaaccgaccgacttcgtcctttcctccccattgcactgggatccaacaatgtcctccgactcgtccaagatcaagaggaagcggaaccgcatcccnttaaacgaaggcg

SEQ ID NO: 728 - DNA, 1031 bp, Arabidopsis thaliana; identical to SEQ ID NO: 205
  misc_feature: T3 Seedling Expression:  GFP expression observed in the Root hair (Rh) of the hypocotyl root zone, the Vasculature (Vs) and Vascular bundle (Vb) of the leaf, the Pericycle (Pr) of the root and lateral root
  misc_feature: T2 Mature Plant Expression:  GFP expression observed in T2 Mature tissue expression (if different expression pattern)., the Ovule (Ov) of the ovary and silique, the Funiculus (Fn) of the ovule primordia, the pre-fertilized and fertilized ovule
  misc_feature (1)..(1031): Ceres Promoter construct YP0028 as found in Promoter Report #30

SEQ ID NO: 729 - DNA, 1075 bp, Arabidopsis thaliana; identical to SEQ ID NO: 209
  misc_feature: T3 Seedling Expression:  GFP expression observed in the Epidermis (Ep) and Root hair (Rh) of the hypocotyl root and root
  misc_feature: T2 Mature Plant Expression:  GFP expression observed in the Guard cells of the flower
  misc_feature (1)..(1075): Ceres Promoter construct YP0030 as found in Promoter Report #31

SEQ ID NO: 730 - DNA, 1106 bp, Arabidopsis thaliana
  misc_feature: T3 Seedling Expression:  GFP expression observed in the Epidermis (Ep) of the hypocotyl root zone and cotyledon, the Epidermis (Ep) and Vascular bundle (Vb) of the root differentiation zone
  misc_feature: T3 Seedling Expression:  GFP expression observed in the seedling root and root tip
  misc_feature (1)..(1106): Ceres Promoter construct YP0054 as found in Promoter Report #32
  misc_feature (1094)..(1094): n is a, c, t, g, unknown, or other
ctgatctctagtccagtcgattggagcttattttgttctattctatcgtatttgattcttctttcgttttttttttgtttgacttaagaaaccgattgtttatagtagtaaacatttgtttttaatgttgctcgattccagtgcacatgtccaggctagacacttgtcgttataaaggttgctttggttcaatattgatccactagagatgttacaactattgttgacatctgagattgtgtgataagaaaatatgaaactggatttagtgaaagttacaatatataatcatacatcatagataggaaataaggaaatgtcagatatacttgaagaatacatcaaatagacaaggtcctttttcttattgtcgactattatagagccgtacagaaccttttcacgtctttagtaattagtacattctccatttcggctctctcttattttttttccatctctttttacttctccaaataataacaataaaagcttcgattttgtgtgtgtttgtatttacatcttgacatcgatattcttttcatcaattttttaccaaaaatgtaataaaaacaaaaaaaaaccaacgctgaacacagacatggtttctccatccgtttatattcatcgtttgtatgtttacttaacaacttatttcaaaatagtacatatcatggttgtgtttttaaaaaaagtatacagaacagaaaagcacatggtagacaaaataatgaagccaaaattaatacaaagaagaagttcaacttgtatttattaacacattttctttccttgtcaaagacatgcaaattggttttgttttcttattcccattttttttttataataaaaagaagaagagtaaaacaaaaaaactatcatttcttcttatcgcaaaactcttatctaagcaagaaaccgacaaaacctatatctacatatattctcatcaacatctcttgagacatattcattttggttaaagcaaaagattttaagagagaaagggggagaagtgagagagaccattgcactgggatccaacaatgtcctccgactcgtccaagatcaagaggaagcggaaccgcatcccnttaacgaaggcg

SEQ ID NO: 731 - DNA, 1017 bp, Arabidopsis thaliana
  misc_feature: T3 Seedling Expression:  GFP expression observed in the Guard cell (Gc) in the leaf
  misc_feature: T2 Mature Plant Expression:  GFP expression observed in T2 Mature tissue expression (if different expression pattern)., the Guard cell (Gc) of the leaf and stem
  misc_feature (1)..(1017): Ceres Promoter construct YP0025 as found in Promoter Report #33
gtcagtgaagtcgattgggtctcaccatgagccaatgaaaagaaatagtaatccaggtgattgtttctctttgatgtctcactttctaatagctagtctctaaaagaacctttgttttagtgaattctaatatagtaggggttttgcagcgcaattttcttcagcaccgaagaaaagtagattgaagatcggagagtcctctgctttctttacatatgtcaaatctactgtccttagaactaacggtcaggatcctcctcttgtcgatggaaatggctcacttcatcttcatcggggtttggcggagaagtttcaagtggtggctagtgaagggatcaacaacaccaaacaagcacgcagagcaacaccaaaatctactgtccttagaactaacggtcaggatcctcctcttgtcaatggaaatggctcacatcatcttcatcggggtgcggcggaaaagtttcaagtggtggctagtgaagggatcaacaacaccaaacaagcacacagaagtagagggaccgagcaataccattctcaaggagagaccttgcagaatggcgccagctatccacattcccttgagcggtcacgcacgcttcccacatcaatggaatctcatggtaggaactaccaagagggcaatatgaatattccccaagttgctatgaacagaagtaaagattcgtctcaagttgatggatcgggtttctctgcaccaaatgcctatccttactatatgcatggggtcatgaaccaagttatgatgcaatcagcagccatgatgcctcaatatggtcatcaaattcctcattgccaaccaaatcatccgaatggaatgacgggatatccttactaccaccacccaatgaacacatctttgcagcatagtcagatgtctttacagaatggtcagatgtctatggttcatcattcttggtcaccggcaggaaatccgccttctaatgaggtgagggtaaataaacttgacagaagagaggaagctctgctgaaatt

SEQ ID NO: 732 - DNA, 1026 bp, Arabidopsis thaliana
  misc_feature: T1 Mature Plant Expression:  GFP expression observed in the Sepal (Se), the Carpel (Ca) and  Style (Sy) in the silique, the Epidermis (Ep) and Mesophyll (Me) of the leaf
  misc_feature: T2 Seedling Expression:  GFP expression observed in the Epidermis (Ep), Root hair (Rh), Root (Rt) and  Vasculature (Vs) of the hypocotyl root zone, the Epidermis (Ep) and Vasculature (Vs) of the hypocotyl
  misc_feature: T2 Seedling Expression:  GFP expression observed in the Epidermis (Ep) and Mesophyll (Me) in the cotyledon, the Guard cell (Gc), Epidermis (Ep) and Mesophyll (Me) in the primary leaf
  misc_feature: T2 Seedling Expression:  GFP expression observed in the Epidermis (Ep), Cortex (Cr) and Phloem (Ph) in the lateral root, the lateral root tip, the primary Root cap (Rc)
  misc_feature: T2 Mature Plant Expression:  GFP expression observed in T2 Mature tissue expressions similar to T1 expression plus, the immature flower, the sepal and the silique pedicle, the Cortex (Cr), Endodermis (Ed) and Epidermis (Ep) in the stem
  misc_feature: T3 Seedling Expression:  GFP expression observed in T3 Seedling tissue expressions similar to T2 seedling expression, the root, the Epidermis (Ep) of the cotyledon, the rosette leaf, the root cap
  misc_feature (1)..(1026): Ceres Promoter construct YP0050 as found in Promoter Report #34
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccatagaacatcaccacctctgttgtcatctcaggaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaacc

SEQ ID NO: 733 - DNA, 1087 bp, Arabidopsis thaliana
  misc_feature: T3 Seedling Expression:  GFP expression observed in the Phloem (Ph) and Epidermis (Ep) of the hypocotyl, the Phloem (Ph) of the hypocotyl root zone, the Phloem (Ph) of the petiole, cotyledon and root, the Pericycle (Pr) of the root
  misc_feature: T2 Mature Plant Expression:  GFP expression observed in T2 Mature tissue expression (if different expression pattern)., the Epidermis (Ep) and Vasculature(Vs) of the inflorescence meristem
  misc_feature: T2 Mature Plant Expression:  GFP expression observed in the Pollen (Po), the Epidermis (Ep), Guard cell (Gc) and Cortex (Cr) of the stem
  misc_feature (1)..(1087): Ceres Promoter construct YP0040 as found in Promoter Report #35
  misc_feature (1077)..(1077): n is a, c, t, g, unknown, or other
cccatcacatgtaacatcattgggctatccaaaagtctaaccaataatgtcaatctataaaccacattaagtagttcattttttttgtagtcgtgtttagcttgttaaacctcataaaatatgttttcacttacgttaacaaaacaaatatcttcacgaaaaaaaataaaataaaatatctttttgataccgaaaaaataaaataaaataaaataattttccctttcgatcataaaatgcgtagataagagaaactgtgtttgaggctccatttcatgttcacctaccagtctaccacgtcatttctcaaagacgcaaattttctaattagggatgtgctctttttacatatagatcaatatcctaaaaaaatttaagatattcatattttcgtacatatatatcgagtttcccgaaaaatccataaaaagggtataatgatagtcctttttctcctttaataataatttctgaacaaaattatatcataataaacttgtgattttatacaaaatttatttgtatatataattttactaaacaacgtgaacgataaaaataatattctcataaaatgttgattaaaaattacttaaaataaataattatttaggattatgtattagtagtactcgaaccatttttttagttatctgcatgaagaccctaatttttcacatatatcgaaactaaaactttggatatacactgtaatttgaaaacgcttggaacggataatgtagttacctcacaagattttgtacatccctgacattttatattcattaaagtgtgtttttttcttcagaaaagaaaacactttttctttttgtgcttttagtttaaattaacaaaaaaatggacaccatgagattccactaactcatgtgtatataacattagggaagcagtcaattcatttcagcatccacacacactttgaatgctcaatcaaagcttcttcatagttaaacttcctcacaacgtcaaaactcgagaagaagaccattgcactgggatccaacaatgtcctccgactcgtccaagatcaagaggaagcggaaccgcatccctttnaacgaaggcg

SEQ ID NO: 734 - DNA, 1071 bp, Arabidopsis thaliana
  misc_feature: T1 Mature Plant Expression:  GFP expression observed in the vasculature (Vs) and Guard Cells (Gc) of the tem and flower
  misc_feature: T2 Seedling Expression:  GFP expression observed in the Guard cell (Gc) of the petiole, cotyledon and leaf
  misc_feature: T2 Mature Plant Expression:  GFP expression observed in the developing flower and pedicle
  misc_feature: T3 Seedling Expression:  GFP expression observed in T3 Seedling tissue expressions similar to T2 seedling expression
  misc_feature (1)..(1071): Ceres Promoter construct YP0041 as found in Promoter Report #36
gggatgcggttccgcttcctcttgatcttggacgagtcggaggacattgttggatcccagtgcaatggtgcaacatcgaatccaaattctcttaacatcataacacagactaaaatttcaggctttcgtgttaaaagagagaatatcattgaactttttctcttaccttcatgattcctgcaagaacagcacctccgaggtataccatgtgtttccttctcggtggatcttcgatccgcaatctgagtttctgattgataagaaaaacgaagataaatgttaaaagctgagctaatgactgacagtgatcatggcattatcagaattatcttttttaccttcaagccatctttgtttccttttagaactgtgtcgagataccgatcctgtatttctttctcaagactagaaacaaacagagaataaaagacattgaaacataaaacaatggaacttcttgctgggtttatgataaacaaaaaatatacgaaccggctaggtaatcctgggtacatggtgctacctccgcttaaaactatgtgttggtagagctgtgaaaaaagagcaaagggtttaagacagatacatgattagttttgttggatctgtcttttgaaataccaagcaagcgtaagagtcacacgtaccatcatgcggttatcaatatccatttcttgaatacatcggaaaaccatgtctgccattccatcaccttcaacatcaatgagttcctgaaaaaatatttggttgtgatcagcctcgagattcttggagggttgaaactattccaaaagagaaattagcagaggacgcgatgaaggtttaccggagtaaaaagcgcttcaggtgcttggaatctttcagtgcctactttgataaccctcccatctggaagctgatcacagttcaaaaacacaacgggttagtactctggaaaaaaaataatttggtgataatatcagctttagaggctgcaactggcacaagtatgaaactttatcgactatcggatgaaaaatcccaaacacagcgcccaagaacagagaaacgatgtcatgaaaagaaaagatg

SEQ ID NO: 735 - DNA, 999 bp, Arabidopsis thaliana; identical to SEQ ID NO: 232
  misc_feature: T2 Mature Plant Expression:  GFP expression observed in the Guard cell (Gc) of the stem and pedicel, the Vascular (Vs) of the leaf
  misc_feature: T3 Seedling Expression:  GFP expression observed in the Root hair (Rh) of the hypocotyl, the Epidermis (Ep) and Mesophyll (Me) of the cotyledon, the Vasculature (Vs) of the cotyledon
  misc_feature: T2 Mature Plant Expression:  GFP expression observed in the inflorescence meristem
  misc_feature: T3 Seedling Expression:  GFP expression observed in the Cotyledon (Co) and Root hair (Rh)
  misc_feature (1)..(999): Ceres Promoter construct YP0056 as found in Promoter Report #37

SEQ ID NO: 736 - DNA, 1080 bp, Arabidopsis thaliana; identical to SEQ ID NO: 237
  misc_feature: T2 Seedling Expression:  GFP expression observed in the collet root hairs only of the hypocotyl root zone
  misc_feature (1)..(1080): Ceres Promoter construct YP0068 as found in Promoter Report #38

SEQ ID NO: 737 - DNA, 1070 bp, Arabidopsis thaliana
  misc_feature: T3 Seedling Expression:  GFP expression observed in the Root hair (Rh) of the Root (Rt)
  misc_feature (1)..(1070): Ceres Promoter construct YP0082 as found in Promoter Report #39
aagggatgcggttccgcttcctcttgatcttggacgagtcggaggacattgttggatcccagtgcaatggtttgtagagaaacaggaagctttgttgagaaagttttaacagtgagtttagtatttatctgagaactgtgtgcgacgaaactggagacaggggaggactatatacaggagttaagtgttgaaggtgggatattgtcagtgagtgaatgttctggagaagtggggagattgatatttctctggatgtttctagagatccgtggctcccaagctaagtgaaacaaatataaattgtcttgtttattaacgggctacggcccatcggtattaggcctgttttagtagatttatggtcaacaagtcaaatgaccctagaacatggtacatgaatgaaaaggaccaaaatgtggacagaaatcaaccaaaggccgaggcggccaccaaccaccgaacgtgggaaggtctggttcgggcaaacattcgaaaagaccaagaagactcggataaacaattaaaaaaatcagatattggggaaggcaaatatatattggtgttgaggtcaagacttagagttttgacgttattttaaaaaaaatatttttgggtaaagaccaaagagtttgacgctatcttgaggtttatttattcaacgtagactatatactatggggccgttctgaattggaccttttaagttttgattttattaaaacgccatgttgtttagtcgagagataaacaaaagacgtgtctctagctaagctgaccttcatatatgctttgacataatacattaattataatctctctttttggtgtgtgtaaaaaatacactctatattttattatgtagacacactacatgcagaagtgttcttacctctgcctctacgtgctgtcaactcctacagatcttcaagtaccccaaccgttatctaacagattaaatataatatacccctaactatattatatatcacaattgttcaaaccagtgtatatagactagacgattccttgaaccatataattccagctttactataagagtcttaaggaca

SEQ ID NO: 738 - DNA, 999 bp, Arabidopsis thaliana
  misc_feature: T2 Seedling Expression:  GFP expression observed in the Epidermis (Ep) and  Root hair (Rh) of the hypocotyl  root transition zone
  misc_feature (1)..(999): Ceres Promoter construct YP0019 as found in Promoter Report #40
ttacgcggcgctacactcttatcaaagtttgaagatttttcaagagacacaacagattcaagattttctggtggctaaacttacaatgacagtacatggaggatctccgcgaatggayttctgcaatgtactagcgtagaacaaacactttttgttaaagtcatcaaccaacatagcatagagttgtttatctgaacagaacactgaaagtcttggttttgtttgtgttccagtaaactgtgtcaaaatgaaagaaaatacttattaacaagttcggcaaaaaaaattcaaacttttgtgcattattatatgaaagcacttctagaaagctaccttcttcctgctcctcctgttcctagttttcggactctccactcgagtgttccctctcgcttcaatcacaaacggctttactacagacatagctgataaaagggtcgaaaaatcatgaaccaagtaagcgaaacagaggataataaacatggaagaagaacagagtaagacgaattataccactcacttgttattcgaattggaaactggggataaggtttcaaacgagttccgagaatgtcagagactctaaactgaacagtagaaagagaagtcaaagcagccatgccaagtatcattcgtaaagcatcgaaagtcagaacattaccctcagcggaatttaatcaaacaccttctgtgcaggaataatctctgggggttttatcaacactcaaaaaaaactggaactttgtaaataaaattataaatgttcgtacctttatgcaaaatttctcacagcgtaattatctatttcctttttgtcctttatgaaagaggataaggtttttaaataataaatactaaattgtttttaaaagaaactaaaaataaatggaaagccttaagcgtcgtcaatggttctagagtcttctgcaactttcttttcatgaaactactgtaatcttctgctaacatatataatctcaaacactatcttctccaatt

SEQ ID NO: 739 - DNA, 999 bp, Arabidopsis thaliana; identical to SEQ ID NO: 245
  misc_feature: T2 Seedling Expression:  GFP expression observed in the Guard cells (Gc) of the cotyledon, petiole and rosette leaf
  misc_feature: T3 Seedling Expression:  GFP expression observed in T3 Seedling tissue expressions similar to T2 seedling expression., the Guard cells (Gc) of the cotyledon
  misc_feature (1)..(999): Ceres Promoter construct YP0084 as found in Promoter Report #41

SEQ ID NO: 740 - DNA, 1015 bp, Arabidopsis thaliana
  misc_feature: T2 Seedling Expression:  GFP expression observed in the Pholem (Ph) of the hypocotyl root transition zone and the root differentiation zone
  misc_feature: T2 Mature Plant Expression:  GFP expression observed in T2 Mature tissue expression (if different expression pattern)., the Recpetacle (Re), Silique (Si) and Vasculature (Vs) of the flower
  misc_feature: T2 Mature Plant Expression:  GFP expression observed in the vascular bundle of the stem, T3 Seedling tissue expressions are similar to T2 seedling expression
  misc_feature (1)..(1015): Ceres Promoter construct YP0087 as found in Promoter Report #42
tgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcaaaaatagataaactcatatcacagtttacacattgaaatcataaacgataattatgtattttgtaataaaaagttagttctgaagctcatactttggatagtcgctagtcgctaatatgctccttgtaataattaaagtcactacgacgcacgtcaaagccgatatttagggcttaattgatgcgtgtttttcttttcatataatagtaatataaattagtactaataaagtatgatggatggttgagacagaaaagaaaaaagatgactgtatggtcatcattacaaagaagaatgtattcttcatgttcttaagaataataaaatgtcacttgtaaatcaagttggtaagcattttgagaactttgttcgatgcaacgtatgatgatttatgtagacaaaagataaaaccgtatcttcaactattgccaagaaaagataaaacctaatctagtcagtctctcaacataaatacaacccaatagccaaactgtgtccaattcggagagaaactaaactaaaacaaaacacaaaagcccaacataagcccaataaaacccattttataaacagaacattactaacactca

SEQ ID NO: 741 - DNA, 1091 bp, Arabidopsis thaliana
  misc_feature: T1 Mature Plant Expression:  GFP expression observed in the Petal (Pe) in the developing flower, the Locules (Lo), Pollen (Po), Silique (Si) and Tapetum ameboid (Tp)
  misc_feature: T2 Seedling Expression:  GFP expression observed in the Epidermis (Ep) and Guard cells (Gc) of the hypocotyl, the Guard cells (Gc) of the petiole, the Phloem (Ph) in the root differentiation zone
  misc_feature: T2 Mature Plant Expression:  GFP expression observed in the Epidermis (Ep) of the pedicle and stem
  misc_feature: T3 Seedling Expression:  GFP expression observed in T2 Mature tissue expression (if different expression pattern)., the Epidermis (Ep) of the cotyledon
  misc_feature (1)..(1091): Ceres Promoter construct YP0180 as found in Promoter Report #43
caatctgatctctagtgccagtcgattggttattgttgaaacggatggtatccagattcatagagttatacgttgttgacctcgtacaggatgaattcattatcttcttcttcttttgcagcatggcaggtgatcgatgggtatgacttgtgatgatagccatgtccaccaaatcagccaagaaaagatcaagacctcggctgcttacgttctgttctataaacgccttgtagactaaagaaactgaagcggaaaagacaagaaagaggtatttgcatttttgccgggtttggcttatttaaaaacatcattggcttgattctaattcactacaagatcaagatgaaagcagctctgcgttgaggctaatttacagaagagagagagagagttgggaagaagagcaaaagaccgagaggacatgttgcggggaatttattttattcttacaaaaattggtatctgattattttattaaccatattcaattagagaatagaagaatagagaaaagcccttttgtgggatatggttctaaattgttgtttagttcttgtgtgtcagttttggctctcgtcgaccaaagaagattaaagaaacctctaccttattttaactcaattcttttgtttttgcaatgtcctttgctttccaaaattgttagtcttacttttcactactttgatagacattgcctttgcgtttccctgattaataagccagagtacttaaatcaaaattgactgttttgtgcatcctgcatcacgtttccaatcagaaccatagtgttgtcgttgtgtcattatccgaatttaagtggagacattggtaagttatttataaactaattacaatctatttttctaattatttcaaataacatatttaagctctgtagcttccactagacggtgaagatttgaagtgagagctctctttgcattgctcacccaccaatggatctacctacccttcttcttcttctcctccttttaaaccctaaaagtttccctttccgttcaacaacgccacaatccattgcactgggatccaacaatgtcctccgactcgtccaagatcaagaggaagcg

SEQ ID NO: 742 - DNA, 999 bp, Arabidopsis thaliana; identical to SEQ ID NO: 260
  misc_feature: T3 Seedling Expression:  GFP expression observed in the Epidermis (Ep) of the hypocotyl
  misc_feature (1)..(999): Ceres Promoter construct YP0186 as found in Promoter Report #44

SEQ ID NO: 743 - DNA, 999 bp, Arabidopsis thaliana
  misc_feature: T2 Mature Plant Expression:  GFP expression observed in the Inner integuments (Ii),  Micropyle (Mp) and Outer integuments (Oi) of the pre-, the Micropyle (Mp) and Outer integuments (Oi) of the post fertilized ovule
  misc_feature: T2 Mature Plant Expression:  GFP expression observed in the ovule containing the early embryo and mature embryo
  misc_feature (1)..(999): Ceres Promoter construct YP0121 as found in Promoter Report #45
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttct

SEQ ID NO: 744 - DNA, 1020 bp, Arabidopsis thaliana; identical to SEQ ID NO: 269
  misc_feature: T1 Mature Plant Expression:  GFP expression observed in the pre-fertilized ovule, the Egg cell (Ec) and Synergid cell (Sn) of the Female gametophyte (Fgm), the Zygote (Zg) an Hour after fertilization (HAF)
  misc_feature (1)..(1020): Ceres Promoter construct YP0096 as found in Promoter Report #46

SEQ ID NO: 745 - DNA, 998 bp, Arabidopsis thaliana
  misc_feature: T2 Mature Plant Expression:  GFP expression observed in the Guard cell (Gc) and Stomata (So) of the stem
  misc_feature: T2 Seedling Expression:  GFP expression observed in the root hairs of the root, the Guard cell (Gc) of the leaf and leaf petiole
  misc_feature: T2 Mature Plant Expression:  GFP expression observed in the inflorescence meristem, pedicel and the pre-fertilized silique
  misc_feature: T3 Seedling Expression:  GFP expression observed in the Epidermis (Ep)
  misc_feature (1)..(998): Ceres Promoter construct YP0098 as found in Promoter Report #47
tatttttataaattatcttagtaaaagtatgtattttctaatagatctgttagttcatacatatcttaattagtgttaaattagatctaatgattagtgataaagtttttagatatcgatataggtgtctttaccatttaacttgaatcctttgttaatgtaaaattttaaaatattttgctttgattctacttattggtatataattttaacatatcaatccaatgccactcttaaattatcatgtacttttcgatatatgttatgactcacttgttatgaaacaatggattttcaccaattttggttatttattaactagaagttttagctcttgtgcaattttaaatgatatgcttttaaaattggtctagttataatagttgtatctataacataaaacttataacaaaactatacttgatattcaaaaattattgatttgctcttgtgaacttcatattagcctagagaactttgaaaacctttcaataaattgtatgtcgaataaagttttacaaacatttattagccatttcgattaagactattgtgagcaaaagttttttttattataaaataaataatatgtttaagataaattgtgagttaggcttcttatattttaaaaattatataagtttatactgaaaaagagttaaaattttcaaattttaaatttatttggcttaagaacataaatatgtcaatttgaaccttatacccactaaatattccatgttagataacgaaataaaagaaaattaactattggtttcttatattgaattggatattgttacttgtatttatgttttttgtttcatttttaaacgttgataaaatcattaaactaaagttttgtagtatatttatttgtcgaaaatttattcccattaaatataacgttaaatttatttgtctttattaaaaaagttactttgtgattttgatttcctatataaaatttagataacttcaattttcaaataaaaaat

SEQ ID NO: 746 - DNA, 999 bp, Arabidopsis thaliana
  misc_feature: T1 Mature Plant Expression:  GFP expression observed in the Vascular (Vs) and Pedicel (Pd) of the inflorescence meristem, the Vascular (Vs) of the sepal, leaf and stem, the Sepal (Se) and Pedicel (Pd) of the flower bud, the Septum (Sp) of the silique
  misc_feature: T2 Seedling Expression:  GFP expression observed in the hypocotyl root transition zone, the Phloem (Ph) of the Root (Rt)
  misc_feature (1)..(999): Ceres Promoter construct YP0108 as found in Promoter Report #48
ttagctgaaccaggaaattgatctcttataccagtttccgggtttagattggtttgatggcgatttgattaaacccccgaaattttatgtcgtagttgtgcatagtattattattctttgcggacaatagacgtatcgggaccaagttctgtagcaaaattgtataagcttaagtttgatgaaatttaaaggtaatcactaaaacccaaatgggacaataaaccggtgaagatttagagtttttaattttgactcatgaatctggagaaagagccctcgttaaaaggagtgaatcaatccataggggaaaaagttttgtctttttaaaaactaaagaaccaaaccttaatagaagcagctcaatgtgtgacaactttccactggcactaagataaagtgactagcgatgagtgcaattattgaaatagtagatggtaaatattacatacaagagtaaaaatatctttatgtcaatgcttaattcagtgtttctggttaacaagagaatcttctctaactttcgtaattgggtcttataaaattttatgcaattatgattttacccttttactacttttcattagctttcacgaatctattttgacaagagaaatcattagaggtaaacatgctttttggtcaagggccttaacagttccaccaatcaagctcaaaagttgtacttaaccgacatcttctgtgaaaacatataattacatgtacaaatcaaaactaccttatgaaataaatagaaatattgcagttcatttctaatttaacctcttcaacttttaaaactatttacatttctttatgtcatttctagtcattttgatgcaaattgtaccatttatggattatcttcacaaatttttaagttggtgaaaactttttggtgggtagttaaaacttgaaatagaaatttactttaccaaaataaactaatgaaaagtaatcactccactccctataataagatttccaacgttcccactaagc

SEQ ID NO: 747 - DNA, 1001 bp, Arabidopsis thaliana
  misc_feature: T1 Mature Plant Expression:  GFP expression observed in the Septum (Sp) and Epidermis (Ep) of the silique Carpel (Ca), Style (Sy).
  misc_feature: T2 Seedling Expression:  GFP expression observed in the Epidermis (Ep) and Root Hair (Rh) of the hypocotyl, the Epidermis (Ep) of the cotyledon, the Atrichoblast (At) and Trichoblast (Tr) of the root differentiation zone
  misc_feature: T2 Mature Plant Expression:  GFP expression observed in the Epidermis (Ep) and Vasculature (Vs) of the silique, the Epidermis (Ep) and Cortex (Cr) of the stem
  misc_feature: T3 Seedling Expression:  GFP expression observed in T3 Seedling tissue expressions similar to T2 seedling expression., the root
  misc_feature (1)..(1001): Ceres Promoter construct YP0134 as found in Promoter Report #49
cctactttaggcttaaacaagaagaaaatatgactgctaagtcatatttttcaactctcatgagcaaccgtaaagttgcaccgcaatatccaacaaatgacattcgtgttatctacaatctaatgttgaaaatttggctcatctaataaaggagacaaaagttatatctctttcacacacacgttaatggaagtgtaaaggcggtgagagtgtgggagagacttggggaacaagaagaaggacgcggtcaaaaagtgacggtgggctacggcttttcttggtagcagttggaaattccattaatgacttaaaaagtgtaaatcttatcttctttttattttgtgatttgatatgcacattcatttcatgaaaatatttgtatagtttgatgatcatacgacaaacttatagggttcacaaagtagatgcaatagttgcatacctctgtttaaatgttcttgttaatattataattgatgacggaactcgtgaatgttattcaaaatgtccatgtaattcaagatcatgcactataataagtaatctatcattttcagcacaacaattttgacaaaaagtaaaaataaaatagagtaaactgatatcatatttccgaattatatatataaacgttttctgtttctcaatggtctctttcactcttgtgttttctaatatttcatttaaacctatttctaaactaagcacatctttgttgattgattgcatttcaaccaaaatcgataaccgaatcattgtttttttatgttttatttcagcttaccacacacgtttagaattttaaaaataaaacaaaaaaaagttaactcgttacaaatgaaaatgatatttttaattggactcgatggaaaggaccaatttattcaacactattgtttagtccgaacacttgccgcgtaagttttccaactccccccattgacctttcgcactttcacaaactccgtatatatataatggatacactctctctttgatct

SEQ ID NO: 748 - DNA, 999 bp, Arabidopsis thaliana; identical to SEQ ID NO: 288
  misc_feature: T2 Mature Plant Expression:  GFP expression observed in the inflorescence meristem, the Epidermis (Ep) of the petal and stem, the Epidermis (Ep), Mesophyll (Me) and Cortex (Cr) of the silique
  misc_feature: T2 Mature Plant Expression:  GFP expression observed in the Epidermis (Ep) and Cortex (Cr) of the stem, the Epidermis (Ep) and Mesophyll (Me) of the leaf
  misc_feature: T2 Seedling Expression:  GFP expression observed in the rosette leaf, the Epidermis (Ep) and Mesophyll (Me) of the cotyledon and rosette leaf
  misc_feature: T2 Seedling Expression:  GFP expression observed in the Vasculature (Vs) of the rosette leaf, the Cortex (Cr) of the lateral root, the root elongation zone and the root tip
  misc_feature: T2 Mature Plant Expression:  GFP expression observed in the Epidermis (Ep) and Cortex (Cr) of the stem, the Micropyle (Mp) of the mature ovule
  misc_feature: T3 Seedling Expression:  GFP expression observed in T3 Seedling tissue expressions similar to T2 seedling expression, T2 Mature tissue expression (if different expression pattern)
  misc_feature: T3 Seedling Expression:  GFP expression observed in the flanking cells of the Lateral root (Lr) in the root transition zone, the Epidermis (Ep) and Mesophyll (Me) of the leaf
  misc_feature (1)..(999): Ceres Promoter construct YP0138 as found in Promoter Report #50

SEQ ID NO: 749 - DNA, 999 bp, Arabidopsis thaliana; identical to SEQ ID NO: 288
  misc_feature: T1 Mature Plant Expression:  GFP expression observed in the Guard cells (Gc) of the flower pedicel, the silique and the stem
  misc_feature: T3 Seedling Expression:  GFP expression observed in the Guard cell (Gc) of the rosette leaf, the Root hair (Rh) of the hypocotyl root transition zone
  misc_feature (1)..(999): Ceres Promoter construct YP0177 as found in Promoter Report #51

SEQ ID NO: 750 - DNA, 1006 bp, Arabidopsis thaliana
  misc_feature: T2 Mature Plant Expression:  GFP expression observed in the Vasculature (Vs) of the inflorescence meristem and the Sepal (Se)
  misc_feature: T2 Seedling Expression:  GFP expression observed in the Guard cell (Gc) and Vasculature (Vs) of the leaf
  misc_feature (1)..(1006): Ceres Promoter construct YP0192 as found in Promoter Report #52
tcctcctactgtctgctacgtcaacaagtggattgcaatcagacggtgattgtgtctcttttcattctctctcttttactaatttctctgataattaaactgagaatgtatattaagaaaaaaaaacaaaaacaagagaggaattttcatacacactaacttaagactctttgtaagttttcccaaatatggattttctagtataaatatgagttcattagtttcaccaagcctacaagcatctctccatctcaaatcatattcacctaaaaatcaggtcccctctctttatatctctaacattcttatatcagatcatattttttggatttcttgttaagtaacaccaatcttttaaaagtgttttcaggttaatataaaagaataatgatgttttcggtgacggttgcgatccttgtttgtcttattggctacatttaccgatcatttaagcctccaccaccgcgaatctgcggccatcctaacggtcctccggttacttctccgagaatcaagctcagtgatggaagatatcttgcttatagagaatctggggttgatagagacaatgctaactacaagatcattgtcgttcatggcctcaacagctccaaagacactgaattttccatccctaaggttcactcttattctcaatattaactctcgtacatgtcacatgcccattttcaccattttagatatacagttttgatactttactttgcatttattttgctatatgtaattgaggatattgttttaatttctttgggtttttttttttcggctaaatgagaattcactgtctttggttcttgaaaaaaaagtatttgttaatggtaaacgctaaacgctatttgagtttatgttttttcaagaactgaaaacgttttattgaaaatatacactttttttgctatttataggaaagcatatcacatcacatctagacgcaaacgcaaaattgagttttaaagcaaccacaatcttaaatgcaatgaaa

SEQ ID NO: 751 - DNA, 1071 bp, Arabidopsis thaliana
  misc_feature: T1 Mature Plant Expression:  GFP expression observed in the inflorescence meristem
  misc_feature: T3 Seedling Expression:  GFP expression observed in the seedling root, the Epidermis (Ep) and Root hair (Rh) of the hypocotyl root transition zone, the Epidermis (Ep) and Root hair (Rh) of the root differentiation zone
  misc_feature (1)..(1071): Ceres Promoter construct YP0204 as found in Promoter Report #53
aactaattaggtcgttaattgtccaagggtttttcatagttgatatagttctgttcaaatatagccatccttaatcgattcatgggatcgtaaattactacttcgagtgttgtaaaaaaaaatgaaacttctacattacaaactcgaatttaatgcatctggagtgatactataaaagtagggatgctctcaggtcgcatttgagagacacagaaatgattttaatggaattaatatattttcagtttttcacaaaaaaaaattgtgtttataacaactgcagattcaatgctgattttatgagtctcacctatagaatttatatttctatattcatagaggcagtataggtgttgacccaacatcgaaagaacacttcgtaaaaaattctttggaacaaggctgaaaatttactcccaaatttagctatccgatgaagataaatcatttaccgtttattaaagaattatcgagattttagtcaaaaccaaaagagattatgagcctaagattttgaatttgtattggtaaaggaaattgaacgaaaatttcagaaaaaaatattaataaattgaacgatagagttcacttactacatagtcaactagtgcctagctataatagtttcaaaagacaaaaaaaacaaaatcggttaactacttccgtgacataattctcatcttgatttttgaatccagtctaatttgaaaagtatattcaaaatctttaaatccattaatgataacttttataatacgttgacacacgcaattgtatatacaatattcttgaattttaaatgtaaattctagaatatattgcgatcaccacactaatcaaaatctttgggacaacttgaacccacatttgacttttcttggtcaaatattttggcatcatgcatgatcttctctataaaaaccaaaaggcctcaacgacattcataaactcagtcattatatttatttttgttgtatttcaacgttcaatctctgaaaaccattgcactgggatccaacaatgtcctccgactcgtccaagatcaagaggaagcggaaccgcatcccgctc

SEQ ID NO: 752 - DNA, 1191 bp, Oryza sativa; identical to SEQ ID NO: 304
  misc_feature: T2 Seedling Expression:  GFP expression observed in the Epidermis (Ep) and Vasculature (Vs) of the cotyledon, the Epidermis (Ep) and Mesophyll (Me) of the primary leaf, the Lateral root (Lr), lateral root initial and lateral root primordia
  misc_feature: T2 Mature Plant Expression:  GFP expression observed in the silique primordia, the Cortex (Cr) and Stigma (Sg) of the developing and fertilized silique, the Vasculature (Vs) of the sepal, mature embryo and the leaf
  misc_feature (1)..(1191): Ceres Promoter construct pCRS-HT2-pGluB-1 as found in Promoter Report #58

SEQ ID NO: 753 - DNA, 1000 bp, Arabidopsis thaliana; identical to SEQ ID NO: 310
  misc_feature: T1 Mature Plant Expression:  GFP expression observed in the Endothelium (Ed) of the mature seed
  misc_feature: T2 Seedling Expression:  GFP expression observed in the Cortex (Cr) of the seedling
  misc_feature (1)..(1000): Ceres Promoter construct YP0008 as found in Promoter Report #60

SEQ ID NO: 754 - DNA, 1000 bp, Arabidopsis thaliana; identical to SEQ ID NO: 314
  misc_feature: T2 Seedling Expression:  GFP expression observed in the Epidermis (Ep) and Cortex (Cr) of the hypocotyl root zone, the Epidermis (Ep), Cortex (Cr)  Pericycle (Pr) and Vasculature (Vs) of the root
  misc_feature: T2 Mature Plant Expression:  GFP expression observed in the Guard cell (Gc), Epidermis (Ep) and Vasculature (Vs) of the leaf, the Vascular bundle (Vb) of the stem
  misc_feature (1)..(1000): Ceres Promoter construct YP0009 as found in Promoter Report #61

SEQ ID NO: 755 - DNA, 1000 bp, Arabidopsis thaliana; identical to SEQ ID NO: 318
  misc_feature: T2 Seedling Expression:  GFP expression observed in the Phloem (Ph) of the root
  misc_feature: T2 Mature Plant Expression:  GFP expression observed in the Guard cell (Gc) of the Pedicel (Pd) and Sepal (Se) of the flower, the Guard cell (Gc) and Vasculature (Vs) of the silique and pre-fertilized silique
  misc_feature: T2 Mature Plant Expression:  GFP expression observed in the Carpel (Ca), Stigma (Sg) and Style (Sy) of the mature silique, the Septum (Sp) of the silique
  misc_feature: T2 Mature Plant Expression:  GFP expression observed in the Hydathode (Hd) of the leaf, the Mesophyll (Me) of the adaxial leaf, the Vasculature (Vs) and Hydathode (Hd) of the abaxial leaf
  misc_feature (1)..(1000): Ceres Promoter construct YP0010 as found in Promoter Report #62

SEQ ID NO: 756 - DNA, 1054 bp, Arabidopsis thaliana
  misc_feature: T1 Mature Plant Expression:  GFP expression observed in the Antipodal cells (Ap), Central cell (Cc), Central cell vacuole (Cv)and Egg cell (Ec) of the pre-fertilized ovule
  misc_feature: T1 Mature Plant Expression:  GFP expression observed in the globular stage, heart stage and torpedo stage embryo in the ovule, the Cotyledon (Co) of the ovule, the mature pollen, the fertilized ovule and embryo
  misc_feature: T2 Seedling Expression:  GFP expression observed in the lateral root primordial, the lateral root, the Cortex (Cr) of the root and the root tip
  misc_feature (1)..(1054): Ceres Promoter construct YP0039 as found in Promoter Report #64
ccgttcgagtatttgaaaatttcgggtacacccgcctaaataggcggaccttatctagtatatatatacatttgaactatattgtttactttttagttgatttaggctatgtcatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactattcgactcagccgtcctttcgcaagaaaccatttggagttggagcttt

SEQ ID NO: 757 - DNA, 1007 bp, Arabidopsis thaliana; identical to SEQ ID NO: 330
  misc_feature: T1 Mature Plant Expression:  GFP expression observed in the Funiculus (Fn), the Chalaza (Ch) of the mature ovule
  misc_feature: T2 Seedling Expression:  GFP expression observed in the Epidermis (Ep) of the petiole, the Hypocotyl (Hy), the Rooot hair (Rh) of the hypocotyl
  misc_feature (1)..(1007): Ceres Promoter construct YP0070 as found in Promoter Report #66

SEQ ID NO: 758 - DNA, 999 bp, Arabidopsis thaliana; identical to SEQ ID NO: 333
  misc_feature: T2 Mature Plant Expression:  GFP expression observed in the Shoot apical meristem (SAM), Silique (Si), Stamen (St) and Sepal (Se) of the, the Placenta Silique (Si), Stamen (St), Sepal (Se)
  misc_feature: T2 Mature Plant Expression:  GFP expression observed in Abscision zone (Az) and Nectary (Ne)  of the, the Carpel (Ca), Ovule (Ov) and Stigma (Sg) of the immature silique
  misc_feature: T2 Mature Plant Expression:  GFP expression observed in the Carpel (Ca), Ovule (Ov) and Placenta (Pl), of the ovary, the Filament (Fi) of the Anther (An) in the stamen, the Cortex (Cr) of the silique
  misc_feature: T2 Mature Plant Expression:  GFP expression observed in the Outer integument (Oi) and Funiculus (Fn) of the pre-fertilized and fertilized ovule
  misc_feature: T2 Mature Plant Expression:  GFP expression observed in the Embryo (Em), Suspensor (Su) and Micropyle (Mp) of the ovule, the Pollen (Po), the Hyphosis (Hp) and Suspensor (Su) of the embryo
  misc_feature: T2 Mature Plant Expression:  GFP expression observed in the Cotyledon (Co) and Root (Rt) of the mature embryo, the Epidermis (Ep), Pith (Pi) and Vascular bundle (Vb) of the stem, the Epidermis (Ep), Mesophyll (Me) and Vascular bundle (Vs) of the
  misc_feature: T3 Seedling Expression:  GFP expression observed in the Hypocotyl (Hy) and Rosette leaf (Rl) in the seedling, the of the cotyledon, the Epidermis (Ep),  Mesophyll (Me) and Vasculature (Vs) of the rosette leaf
  misc_feature: T3 Seedling Expression:  GFP expression observed in the Epidermis (Ep),  Vasculature (Vs)  and Root hair (Rh) in the hypocotyl root, the Vasculature bundle (Vb), Cortex (Cr) and Epidermis (Ep) of the root
  misc_feature (1)..(999): Ceres Promoter construct YP0086 as found in Promoter Report #68

SEQ ID NO: 759 - DNA, 1106 bp, Arabidopsis thaliana; identical to SEQ ID NO: 338
  misc_feature: T1 Mature Plant Expression:  GFP expression observed in the Hypophysis (Hp) and Suspensor (Su) of the heart stage embryo, the torpedo stage embryo, the Root apical meristem (RAM) of the mature embryo, the mature embryo
  misc_feature: T2 Seedling Expression:  GFP expression observed in the rosette leaf, the Lateral root (Lr)., the Epidermis (Ep) of the root, the Lateral root tip and the root timp
  misc_feature (1)..(1106): Ceres Promoter construct YP0088 as found in Promoter Report #69

SEQ ID NO: 760 - DNA, 1004 bp, Arabidopsis thaliana
  misc_feature: T1 Mature Plant Expression:  GFP expression observed in the Chalaza (Ch), Female gametophyte (Fgm), Funiculus (Fn) and Micropyle (Mp) of the, the Embryo (Es), the Mesophyll (Me) of the leaf
  misc_feature: T2 Seedling Expression:  GFP expression observed in the Hypocotyl (Hy) root, the Hypocotyl (Hy) root zone, the Root hair (Rh), the Cortex (Cr) and Epidermis (Ep) of the root
  misc_feature: T2 Seedling Expression:  GFP expression observed in the Epidermis (Ep) and Root hair (Rh) of the lateral root, the Epidermis (Ep) of the root tip
  misc_feature (1)..(1004): Ceres Promoter construct YP0101 as found in Promoter Report #70
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttgaccacacgcctatatataaaacataaaagccctttcccc

SEQ ID NO: 761 - DNA, 1000 bp, Arabidopsis thaliana
  misc_feature: T1 Mature Plant Expression:  GFP expression observed in the Funiculus (Fn), Inner integument (Ii), Megaspore mother cell (Mmc) and Outer, the Funiculus (Fn) and Outer integument (Oi) of the pre-fertilized ovule, the Seed coat (Sc) of the developing
  misc_feature: T2 Seedling Expression:  GFP expression observed in the Epidermis (Ep) of the hypocotyl, root and root tip, the Root hair (Rh) of the hypocotyl-root transition zone, the Vascular (Vs) of the cotyledon
  misc_feature (1)..(1000): Ceres Promoter construct YP0115 as found in Promoter Report #71
atgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttactaattttcacaga

SEQ ID NO: 762 - DNA, 1009 bp, Arabidopsis thaliana; identical to SEQ ID NO: 354
  misc_feature: T1 Mature Plant Expression:  GFP expression observed in the Guard cell (Gc)
  misc_feature: T2 Seedling Expression:  GFP expression observed in the Epidermis (Ep) of the Rosette leaf (Rl) and Petiole (Pt)  in the seedling, the Epidermis (Ep) and Root hair (Rh),of the root
  misc_feature (1)..(1009): Ceres Promoter construct YP0133 as found in Promoter Report #72

SEQ ID NO: 763 - DNA, 1001 bp, Arabidopsis thaliana; identical to SEQ ID NO: 358
  misc_feature: T1 Mature Plant Expression:  GFP expression observed in the Egg apparatus (Ea ) of the ovule and fertilized ovule, the Antipodal cells (Ap), Central cell (Cc), Synergid cell (Sn), Egg sac (Es), Egg
  misc_feature: T1 Mature Plant Expression:  GFP expression observed in the Antipodal cells (Ap), Central cell (Cc), Synergid cell (Sn) and Egg apparatus, the Antipodal cells (Ap), Central cell (Cc), Cv, Sc and Micropyle (Mp) in an abnormal
  misc_feature: T2 Seedling Expression:  GFP expression observed in the Root hair (Rh) of the root, the Epidermis (Ep) of the root and Lateral root (Lr), the upper and lower portions of the root, the Endodermis (Ed) of the root
  misc_feature (1)..(1001): Ceres Promoter construct YP0137 as found in Promoter Report #73

SEQ ID NO: 764 - DNA, 1003 bp, Arabidopsis thaliana; identical to SEQ ID NO: 362
  misc_feature: T1 Mature Plant Expression:  GFP expression observed in the flower, the Carpel (Ca), Stigma (Sg) and Style (Sy) of the Silique (Si), the Cortex (Co) and Epidermis (Ep) of the carpel, the Guard cell (Gc) of the carpel
  misc_feature: T1 Mature Plant Expression:  GFP expression observed in the Epidermis (Ep) and Mesophyll (Me) of the leaf, the Vasculature of the leaf, the Cortex (Cr) and Epidermis (Ep) of the stem
  misc_feature: T2 Seedling Expression:  GFP expression observed in the Cotyledon (Co), Hypocotyl (Hy) and Rosette leaf (Rl) of the seedling, the Epidermis (Ep) of the seedling Cotyledon (Co), Hypocotyl (Hy) and Rosette leaf (Rl)
  misc_feature (1)..(1003): Ceres Promoter construct YP0144 as found in Promoter Report #74

SEQ ID NO: 765 - DNA, 1001 bp, Arabidopsis thaliana
  misc_feature: T1 Mature Plant Expression:  GFP expression observed in the flower Guard cells and Guard cells of the Sepal (Se), the stem Guard cells, the Cotyledon (Co) and Radicle (Rd) of the ovule
  misc_feature: T1 Mature Plant Expression:  GFP expression observed in the Radicle (Rd) of the torpedo stage embryo, the Cotyledon (Co) and Radicle (Rd) of the embryo, the Root cap (Rc) of the mature embryo, the Cotyledon (Co)
  misc_feature (1)..(1001): Ceres Promoter construct YP0143 as found in Promoter Report #75
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaagataaaatttcgcaagaagatttttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatcactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaac

SEQ ID NO: 766 - DNA, 1004 bp, Arabidopsis thaliana; identical to SEQ ID NO: 370
  misc_feature: T2 Seedling Expression:  GFP expression observed in the root, the Epidermis (Ep) and Root hair (Rh) of the root, the lateral root primordial and lateral root tip, the root tip
  misc_feature (1)..(1004): Ceres Promoter construct YP0156 as found in Promoter Report #76

SEQ ID NO: 767 - DNA, 1000 bp, Arabidopsis thaliana; identical to SEQ ID NO: 374
  misc_feature: T1 Mature Plant Expression:  GFP expression observed in the Epidermis (Ep) and Vasculature (Vs) of the flower/pedicle, the Vasculature (Vs) of the flower petal, the Epidermis (Ep) and Cortex (Cr) of the stem
  misc_feature: T2 Seedling Expression:  GFP expression observed in the Shoot apical meristem (SAM) of the inflorescence meristem, the Epidermis (Ep) and Vasculature (Vs) of the rosette leaf and root, the Hydothode (Hd)
  misc_feature: T2 Seedling Expression:  GFP expression observed in Epidermis (Ep) and Vasculature (Vs) of the cotyledon, the seedling, the Epidermis (Ep) and Vasculature (Vs) of the hypocotyl, the Epidermis (Ep) and Root hair (Rh) of the hypocotyl/root
  misc_feature (1)..(1000): Ceres Promoter construct YP0158 as found in Promoter Report #77

SEQ ID NO: 768 - DNA, 997 bp, Arabidopsis thaliana; identical to SEQ ID NO: 378
  misc_feature: T1 Mature Plant Expression:  GFP expression observed in the Epidermis (Ep) and Vasculature (Vs) of the inflorescence, the Sepals (Se) and Shoot apical meristem (SAM), the Vasculature (Vs) of the stamen filament, the Nectary (Ne) and Ovule (Ov) of the
  misc_feature: T1 Mature Plant Expression:  GFP expression observed in the Epidermis (Ep) and Cortex (Cr) of the silique, the Placenta (Pl), Ovule (Ov) and Funiculus (Fn) of the ovary, the Outer integument (Oi) of the ovule, the Embryo (Em) of the ovule at the globular
  misc_feature: T1 Mature Plant Expression:  GFP expression observed in the Embryo (Em) and the Root apical meristem (RAM) of the embryo at the heart stage, the Embryo (Em) at the torpedo stage
  misc_feature: T1 Mature Plant Expression:  GFP expression observed in the Root apical meristem (RAM) of the mature embryo, the root tip, the Pith (Pi), Cortex (Cr) and Vascular bundle (Vb) of the stem
  misc_feature: T2 Seedling Expression:  GFP expression observed in the Epidermis (Ep), of the hypocotyl, the Lateral root (Lr) and Vasculature (Vs) of the root, the lateral root tip
  misc_feature: T2 Seedling Expression:  GFP expression observed in the Pericycle (Pr) and Vasculature (Vs) of the lateral root initial, the lateral root primordial, the Root apical meristem (RAM) of the root tip
  misc_feature (1)..(997): Ceres Promoter construct YP0164 as found in Promoter Report #79

SEQ ID NO: 769 - DNA, 1000 bp, Arabidopsis thaliana; identical to SEQ ID NO: 386
  misc_feature: T1 Mature Plant Expression:  GFP expression observed in the silique, the Inner integument (Ii) of the ovule, the Endosperm (En) and Inner integument (Ii) of the ovule ath the torpedo stage
  misc_feature: T1 Mature Plant Expression:  GFP expression observed in the Outer integument (Oi) of the ovule at the zygote stage, the Inner integument (Ii) and Outer integument (Oi) of the ovule, the Seed coat (Sc) of the seed
  misc_feature (1)..(1000): Ceres Promoter construct YP0119 as found in Promoter Report #80

SEQ ID NO: 770 - DNA, 1000 bp, Arabidopsis thaliana; identical to SEQ ID NO: 390
  misc_feature: T1 Mature Plant Expression:  GFP expression observed in the Stigma (Sg) and Style (Sy) of the distal silique, the Carpel (Ca) of the proximal silique
  misc_feature: T2 Seedling Expression:  GFP expression observed in the Vasculature (Vs), Pericycle (Pr), Endothelium (Ed) and Epidermis (Ep) of the root
  misc_feature (1)..(1000): Ceres Promoter construct YP0171 as found in Promoter Report #82

SEQ ID NO: 771 - DNA, 1005 bp, Arabidopsis thaliana
  misc_feature: T1 Mature Plant Expression:  GFP expression observed in the Guard cell (Gc), of the Pedicel (Pd) and Sepal (Se), the Placenta (Pl) and Funiculus (Fn), the Suspensor (Su) of the early globular embryo
  misc_feature: T1 Mature Plant Expression:  GFP expression observed in the Suspensor (Su), Embryo (Em), Hypocotyl (Hy) and Outer integument (Oi) of, the Suspensor (Su) and Embryo (Em) of the early heart stage embryo
  misc_feature: T1 Mature Plant Expression:  GFP expression observed in the mid-heart, late heart and torpedo stage embryo, the leaf Epidermis (Ep), Mesophyll (Me) and Vasculature (Vs), the Cortex (Cr), Epidermis (Ep) and Guard cell (Gc) of the stem
  misc_feature: T2 Seedling Expression:  GFP expression observed in the Vasculature (Vs), Epidermis (Ep) and Root hair (Rh) of the hypocotyl-root transition, the Vasculature (Vs), Hydathode (Hd), Epidermis (Ep) and Mesophyll (Me)
  misc_feature: T2 Seedling Expression:  GFP expression observed in the Epidermis (Ep) and Mesophyll (Me) of the rosette leaf, the Vasculature (Vs) and Epidermis (Ep) of the root, the Pericycle (Pr) of the Lateral root (Lr), the lateral root primordial
  misc_feature (1)..(1005): Ceres Promoter construct YP0188 as found in Promoter Report #84
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactga

SEQ ID NO: 772 - DNA, 1000 bp, Arabidopsis thaliana; identical to SEQ ID NO: 395
  misc_feature: T1 Mature Plant Expression:  GFP expression observed in the Epidermis (Ep), Guard cell (Gc) and Vasculature (Vs) of the Sepal (Se) in developing
  misc_feature: T2 Seedling Expression:  GFP expression observed in the Epidermis (Ep), Hypocotyl (Hy) and Root hair (Rh) of the hypocotyl root transition, the Epidermis (Ep) of the root
  misc_feature (1)..(1000): Ceres Promoter construct YP0258 as found in Promoter Report #85

SEQ ID NO: 773 - DNA, 1000 bp, Arabidopsis thaliana
  misc_feature: T1 Mature Plant Expression:  GFP expression observed in the inflorescence meristem, the Epidermis (Ep) and Vasculature (Vs) in the Sepal (Se) of the inflorescence
  misc_feature: T1 Mature Plant Expression:  GFP expression observed in the Epidermis (Ep) and Vasculature (Vs) in the Petal (Pe), the Vasculature (Vs) in the Filament (Fi) of the stamen
  misc_feature: T1 Mature Plant Expression:  GFP expression observed in the Guard cell (Gc) and Vasculature (Vs) in the silique, the Guard cell (Gc) in the Style (Sy) of the silique, the Cortex (Cr), of the Carpel (Ca) in the silique
  misc_feature: T1 Mature Plant Expression:  GFP expression observed in the Guard cell (Gc), Septum (Sp) and Vasculature (Vs) of the proximal silique
  misc_feature: T1 Mature Plant Expression:  GFP expression observed in the Placenta (Pl), the Funiculus (Fn), the Placenta (Pl) of the ovary, the Outer integument (Oi), Funiculus (Fn), Placenta (Pl) and Vasculature (Vs) of the pre-, the Embryo (Em) of the
  misc_feature: T1 Mature Plant Expression:  GFP expression observed in the Hypocotyl (Hy) of the heart stage embryo, the Outer integument (Oi) of the fertilized ovule, the adaxial and abaxial leaf, the Epidermis (Ep) and Vasculature (Vs) of  the stem
  misc_feature: T2 Seedling Expression:  GFP expression observed in the Root hair (Rh) of the hypocotyl root transition zone, the Epidermis (Ep) of the cotyledon
  misc_feature: T2 Seedling Expression:  GFP expression observed in the Epidermis (Ep) and Trichome (Tc) of the rosette leaf, the Epidermis (Ep) and Root hair (Rh) of the root, the root tip
  misc_feature (1)..(1000): Ceres Promoter construct YP0265 as found in Promoter Report #86
gtcgattggttttttttttacggtttcctgcaaattaatccattttaaacaaatcctccattgttttgtataatgttggagattagtaggattagtcggataatatggcataaacataatatgatgctaaattctaaagaaacgatatgaataaataatgcagcagtataaaaactgtaccattgcgtgggtggaggattttaggtcattgttagggcactttcatggggaccatttccgccttaacgaagacttattacacacaaccgtcaatgtgggctggaaacttgcagtgcaatccggtctggtcctataatttatggccggttagggtttacaagtttttaatctatcaattaaatgagatggacacaaaatgtaatcaccagtggaaaagaaaacattacgagacttatacaatgtctacaagaagactcgagtggggcaacatgttgtacataatccgacgtcgttttgggagtcagtaaataaagttcgagaaatgacgtcgttttgaagtcatccgagagaaaatgacttaaagtgaccgacgttgttttgaagtcagcggaagagtaaagaagtaagaaacgaagtcgttttgaagtcatctcttcagatatgtttgttctaattaaaatttcccaagtgggaattagtttgtaattgaaggtatgcacgatttttagttacaattttaattcttcttcttcagatccaagaactctcagtctctgcgttcacactctttctttgaatccttcatcatcctaattcatctccaagaactgaatcagaagttgtatttcgctaattcaacttttccaggtaattttccattcctcgattattcgaatttgggtattaaatcataatgcatcgggaaatttggattctttaggataatttttccggcaaatccgattattgagctagtttctgaatgtttagattctcagtgtctgtcaattaggttttgattttggaagtagagaagtta

SEQ ID NO: 774 - DNA, 986 bp, Arabidopsis thaliana; identical to SEQ ID NO: 436
  misc_feature: T1 Mature Plant Expression:  GFP expression observed in the flower bud and inflorescence meristem, the Cortex (Cr) of the Receptacle (Re) and the Vasculature (Vs) of the Sepal (Se) of the, the Vasculature (Vs) of the leaf and mid-vein rib
  misc_feature: T2 Seedling Expression:  GFP expression observed in the Vasculature (Vs) and Cortex (Cr)  of the hypocotyl, the Vasculature (Vs) and Guard cells (Gc) of the leaf
  misc_feature: T2 Seedling Expression:  GFP expression observed in the Epidermis (Ep) and Mesophyll (Me) of the rosette leaf, the Vasculature (Vs) of the petiole, the Vasculature (Vs) of the root transition zone
  misc_feature (1)..(986): Ceres Promoter construct YP0071 as found in Promoter Report #99

SEQ ID NO: 775 - DNA, 1100 bp, Arabidopsis thaliana
  misc_feature: T1 Mature Plant Expression:  GFP expression observed in the Anther (An), Petal (Pe) and Sepal (Se) of the inflorescence meristem, the Anther (An), Silique (Si), Ovule (Ov), Placenta (Pl), Petal (Pe) and Sepal (Se) of the, the leaf, sepals of
  misc_feature: T2 Seedling Expression:  GFP expression observed in the Root hair (Rh) and Vasculature (Vs) of the hypocotyl-root transition zone, the Epidermis (Ep) of the hypocotyl
  misc_feature: T2 Seedling Expression:  GFP expression observed in the Epidermis (Ep) and Vasculature (Vs) of the root, the Epidermis (Ep) and Vasculature (Vs) of the cotyledon petiole
  misc_feature: T2 Seedling Expression:  GFP expression observed in the Epidermis (Ep), Mesophyll (Me) and Vasculature (Vs) of the rosette leaf, the Epidermis (Ep), Vasculature (Vs) of the Cortex (Cr), Endothelium (Ed), Pericycle, the primary root cap
  misc_feature (1)..(1100): Ceres Promoter construct YP0214 as found in Promoter Report #100
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccccattgcactggacactctcatcttctttttcccgtgtcagtttgttatataagctctcactctccggtatatttccccattgcactgg

SEQ ID NO: 776 - DNA, 990 bp, Arabidopsis thaliana
  misc_feature: T1 Mature Plant Expression:  GFP expression observed in the Epidermis (Ep) of the inflorescence meristem, the Embryo (Em) and Placenta (Pl) of the ovule, the Vascular bundle (Vb) of the stem
  misc_feature: T2 Seedling Expression:  GFP expression observed in the Epidermis (Ep), Mesophyll (Me), Hydathode (Hd) and Vasculature (Vs) of the, the Epidermis (Ep), Mesophyll (Me) and Vasculature (Vs) of the rosette leaf,  (Cr), Lateral root (Lr), Rosette leaf (Rl)
  misc_feature (1)..(990): Ceres Promoter construct YP0216 as found in Promoter Report #101
  misc_feature (453)..(453): n is a, c, t, g, unknown, or other
ttttgtttctaatagtttgatgtttatatcaacattattatttactttcatttgttaccgatagaaagaggagaaaattgttgacaaaaacaaagataaaagtaaaattaatattattaaattaataaaaataacaaactgtaaaagctatttttttaaaaattttgtgtaaaacatctaaaaattattcttttagaaacagaagaatatcattgaagataatagtgtgaaattatatatatatatagaaatatataaagtaggatttttttctgtatacaaatatacgtttccaattttatcaaaaactgtaaagatttttttctttgtcagtacctgctaaacttgttaatttttttattaaaaaaaaatcaaattacaattcttctataatcattttaaattccatttctttataccacaaaagattatattgcctttatcgtctttggnatgtatgcgtgaatatatttatttattttcttttctttcattttctttttaaagaactttataaatgaaataaggaacaaacaatatacatatgtactaacgtatataaataatatcatcaatatctatccaaaacttggatttcatggttgacgtggcccaaccaaaatctcaagttctctgcggatgacgaaccatctcaccatctctttttttctctctctttttttttttaatatcatcagcacggttacataaaattcgtgatccatgaagttggctttcttgtcgttttacttcatcaccccattttttaaaagtctccatctttatacttcttcaactctccaccaccaccattgtcaccaccacatttaaacacacactttcacttgtagtgggattagaaagtgcgttttattcatttgttttactgtttttgataacctcaaaatttgcctaaattttattctctataaatccttatatgttttacttacattcctaaagttttcaactttcctgagcttcaaaaag

SEQ ID NO: 777 - DNA, 984 bp, Arabidopsis thaliana; identical to SEQ ID NO: 77
  misc_feature: T1 Mature Plant Expression:  GFP expression observed in the Megaspore mother cell (Mmc), Outer integument (Oi) and Funiculus (Fn) of the ovule, the Suspensor cells (Su) of the globular embryo stage in the ovule
  misc_feature: T1 Mature Plant Expression:  GFP expression observed in the Suspensor apparatus. After first asymmetrical cell division of zygote, the larger basal, the Suspensor cells (Su) of the heart stage embryo, the Micopyle (Mp)
  misc_feature (1)..(984): Ceres Promoter construct YP0271 as found in Promoter Report #102

SEQ ID NO: 778 - DNA, 979 bp, Arabidopsis thaliana
  misc_feature: T1 Mature Plant Expression:  GFP expression observed in the Embryo (Em), Embryo sack (Es) and Micropyle (Mp) of the fertilized ovule, the Embryo proper (Ep) and Suspensor (Su) of the zygote
  misc_feature: T1 Mature Plant Expression:  GFP expression observed in the Micropyle (Mp) pole of the ovule, the fertilized ovule, the Radicle (Rd) and Root apical meristem (Ram) of the torpedo stage embryo
  misc_feature: T2 Seedling Expression:  GFP expression observed in the Epidermis (Ep), Guard cells (Gc) and Mesophyll (Me) of the rosette leaf, the root and root transition zone, the Pericycle (Pr) of the lateral root initials, the lateral root primordia
  misc_feature (1)..(979): Ceres Promoter construct YP0279 as found in Promoter Report #103
cgctttattataggtttaacaattgatttttcattattttgttttcaatctccaaatcatttctcaataactctcaaacattgtttaaagctttttttcttaattaacattataacaaaaaaataaatagagaaatttactttgattcaaacaccagtcattgtagattagccaagagttttcagtaacaaaatttaccttataaaccttttgaatggctatttctgaaatggaatagaaatctttagtcgtggaagtatctctatccataagaaaactcgttttacaaagtaattttaaatcaatacaaaaaagtgaaaaaatccactggtggaccccattcattccagaattgccgattacgagctatcttgtcccttcttcaccattcgctcactctctctctctctctctcgtcttcttcttcccaccactctctctgtttctccacaacttctcttctcaaagttaaaattacccctaaaccaaaaaaaaaaaaacgctcttcactatttatttactaaactctcctttgtttgttactaagctctcactaaaaccctaatctttctcctcttatatatctcgtgactcttctttctcctccaatctctctctccctcttcacaaaccaattagcttctttctgtaaaacctcactcgttggccaattcttttggttttcatacacataaatctcagattccaaatgggttttcttagctctttctttcaaatgatgaacatttgttagcagaatcttcctcattccctaaagttttgatctttttttcccccttcaattttgtattttctcaccaaataaaaaaaggtttcttcagtgggttttaagggtttattattatcttaaaattaaacacaattctttaatcaaaaggcaaaaatcttaatttcatcactctcttctcactcacaaaagttcttacaatcttcaaagttttggtcttgtttcttttcc

SEQ ID NO: 779 - DNA, 981 bp, Arabidopsis thaliana; identical to SEQ ID NO: 85
  misc_feature: T1 Mature Plant Expression:  GFP expression observed in the Vasculature (Vs) of the leaf, the Embryo sack (Es) of the pre-fertilized and fertilizad ovule
  misc_feature: T2 Seedling Expression:  GFP expression observed in the Vasculature (Vs) of the hypocotyl, the Vasculature (Vs) and Epidermis (Ep) of the root transition zone, the Hydathode (Hd) and Vasculature (Vs) of the cotyledon
  misc_feature: T2 Seedling Expression:  GFP expression observed in the Pericycle (Pr), Vasculature (Vs) and Epidermis (Ep) of the root
  misc_feature (1)..(981): Ceres Promoter construct YP0285 as found in Promoter Report #105

SEQ ID NO: 780 - DNA, 982 bp, Arabidopsis thaliana; identical to SEQ ID NO: 89
  misc_feature: T1 Mature Plant Expression:  GFP expression observed in the vasculature of the inflorescence meristem, the Petal (Pe) and Silique (Si) of the flower, the Medial vasculature (Mv) in the silique, the Vascular bundle (Vb) of the leaf and stem
  misc_feature: T2 Seedling Expression:  GFP expression observed in the Rosette leaf (Rl), the Vascular(Vs) of the hypocotyly, leaf and root, the Pericycle (Pr) of the root and lateral root
  misc_feature (1)..(982): Ceres Promoter construct YP0080 as found in Promoter Report #106

SEQ ID NO: 781 - DNA, 987 bp, Arabidopsis thaliana
  misc_feature: T2 Seedling Expression:  GFP expression observed in the Epidermis (Ep) of the root transition zone, the root and the cotyledon, the Vasculature (Vs) of the cotyledon
  misc_feature (1)..(987): Ceres Promoter construct YP0122 as found in Promoter Report #107
agtttaattatttgttatctatccaatcaatttttttttctaaactgtttggaccaatgtacgtacgtaccatcctttttgattttttttgtaaactaaattttcggattagcaggttcttaataattgaacgaagaaaataaagaatagaggtagacacctgtagtattttcttggtcagaccaataatttataattcaacgtcaaagaagaagaaaaatataaaccattatttcattatgacttacgtataccaaaatacacaaattaaatgtataattgtgaggcattttatatgcgggaaaaaataaaataaaaagaatattaatatttcttttgaaaattgtaaagcattttgacccacttgtgatatatatatatagatatatatagagagagagattaaaacattgatggctagctatagagtctatggcagggtcatgatcacctatcttctgatctctgaagagataccaatctgattttttctcttcctaggtttaattttattttaccattttataattctttatttttgcctgtagtacaatttacagacccatactaaaagaaaaattaaattttgtcaaagtacaaaacaaagagagaggtgaagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaaratttgcctttctattttgtttattggttctttttaactttttcttggagatgggttcttgtagatcttaatgaaacttctgtttttgtcccaaaaagagttttcttttttcttctcttcttttttggttttcaattc

SEQ ID NO: 782 - DNA, 999 bp, Arabidopsis thaliana
  misc_feature: T1 Mature Plant Expression:  GFP expression observed in the Vasculature (Vs) of the flower and the Silique (Si)
  misc_feature: T2 Seedling Expression:  GFP expression observed in the Vasculature (Vs) of the hypocotyl and root
  misc_feature (1)..(999): Ceres Promoter construct YP0226 as found in Promoter Report #108
ctccttgataatgattttgatcaaaagtgtaatttccacaaaccaattgcgcctgcaaaagttttcaaaggatcatcaaacataatgatgaatatctcatcaccacgattttataataatgcatcttttcccaccattttttttccctcactttcttttataatcttgttcgacaacaatcatggtctaaggaaaaagttgaaaatatatattatcttagttattagaaaagaaagataatcaaatggtcgatatgcaaatggcatatgaccataaacgagtttgctagtataaagaatgatggccaacctgttaaagagagactaaaattaggtctaaaatctaggagcaatgtaaccaatacatagtatatgaaatataaaagttaatttagattttttgattagcccaaattaaagaaaaatggtatttaaaacagagactcttcatcctaaaggctaaagcaatacaatttttggttaagaaaagaaaaaaaccacaagcggaaaagaaaacaaaaaaaactatattatgatgcaacagcaacacaaagcaacaccttgcacacacacatacaactgtaaacaagtttcttgggactctctattttctcttgctgcttgaaccaaacacaacaacgatatcccaacgagagcacaacaggtttgattatgtcggaagacaagttttgagagaaaacaaacaatattttataacaaaggagaagacttttggttaggaaaaattggtatggccattacaagacatatgggtcccaattctcatcactctctccaccaccaaaatcctcctctctctctctctcttttactctgttttcatcatctctttctctcgtctctctcaaaccctaaatacactctttctcttcttgttgtctccattctctctgtgtcatcaagcttcttttttgtgtgggttatttgaaagacactttctctgctggtatcattggagtctagggttttgttattgaca

SEQ ID NO: 783 - DNA, 1002 bp, Arabidopsis thaliana
  misc_feature: T1 Mature Plant Expression:  GFP expression observed in the pollen
  misc_feature (1)..(1002): Ceres Promoter construct YP0244 as found in Promoter Report #110
ttgatttgatgtatagttactatttaaagtcttatttgtgaaattttacaaatgttggaaaaaagcattttatggtgctatatttgtcagtttcccttgattatatatccttttgaaaagtaatgttttttttatgtgtgtgtattcatgaaccttggaaaaactacaaatcagatcatggtctgttttaggtgaaaaatttagaacacagttacgcaagaaagatatcggtaaatttttgtttctttgaatcgaaattaatcaaaaagtattttccattatataacaacaactaatctctgttttttttttttttttttaacaactaatctcttatcaaaatgacactacagaatcacgattgtaaatcttcaaaagggcagtctgaaaaaatattcatgaggatgagattttattcattcatggttgtaagtaatcattatgtaaagtttaggataaggacgttcaaaatcatataaaaaaactctacgaataaagtttatagtctatcatattgattcatatttcatagaaagttactggaaaacattacacaagtattctcgatttttacgagtttgtttagtagtcgcaaaattttattttacttttgagtatacgaacccataagctgattttctttccaagttccaataatgatatcatagtgtactcttcatgaatgtttcaagcatataattataacgttcataagtaacattctactgcatgtttgttattataaattaactaataatcgaacgtatgagttttggttgagattgttgtgctcacgaaatgaaggactcggtcaattctaaagcttaaaataagaagctcagatcttaaaactcgctttcgtcttcgtcctccatttaagtttgcgattcttttgctcttctttctctctcacatttttgtcccaaaacaataaaaagaaacaataatagaaagtgttacagaaaaagaaagaaaactatcattgaagttgggaaggagaaa

SEQ ID NO: 784 - DNA, 996 bp, Arabidopsis thaliana
  misc_feature: T1 Mature Plant Expression:  GFP expression observed in the Pedicel (Pd) of the inflorescence meristem and the flower, the stem
  misc_feature: T2 Seedling Expression:  GFP expression observed in the Epidermis (Ep) of the Hypocotyl (Hy), Rosette leaf (Rl), Cotyledon (Co), root, the Mesophyll (Me) and Vasculature (Vs)  of the cotyledon
  misc_feature (1)..(996): Ceres Promoter construct YP0286 as found in Promoter Report #111
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatacatatatctatgaataagtgtgtatgacataagaaactaaaatatttacctaaagtccagttactcatactgatttcatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 785 - DNA, 998 bp, Arabidopsis thaliana
  misc_feature: T1 Mature Plant Expression:  GFP expression observed in the Endothelium (Ed), Stomium region (StR), Pollen (Po) of the developing, mature and dehiscing anther
  misc_feature: T2 Seedling Expression:  GFP expression observed in the Epidermis (Ep) of the Cotyledon (Co), cotyledon petiole and root, the Guard Cells (Gc) of the coteledon
  misc_feature: T2 Seedling Expression:  GFP expression observed in the Hypocotyl (Hy)-root transition zone, the Root hair (Rh), the Trichomes (Tc) of the Rosette leaf (Rl)
  misc_feature (1)..(998): Ceres Promoter construct YP0289 as found in Promoter Report #112
atggacttttcttctattatatggtcaaacaattactgctcaatgtatttgcgtatagagcatgtccaataccatgcctcatgatgtgagattgcgaggcggagtcagagaacgagttaaagtgacgacgtttttttgttttttttgggcatagtgtaaagtgatattaaaatttcatggttggcaggtgactgaaaataaaaatgtgtataggatgtgtttatatgctagacggaaaaatagttactcaactaatacagatctttataaagagtatataagtctatggttaatcatgaatggcaatatataagagtagatgagatttatgtttatattgaaacaagggaaagatatgtgtaattgaaacaatggcaaaatatatagtcaaatcaaactggtttctgataatatatgtgttgaatcaatgtatatcttggtattcaaaaccaaaacaactacaaccaatttctttaaaaaaccagttgatctaataactacattttaatactagtagctattagctgtatttcataatcaatttcttgcattaaaatttgaagtgggttttgcatttaaacttactcggtttgtattaatagactttcaaagattaaaagaaaactactgcattcagagaataaagctatcttactaaacactacttttaaagtttcttttttcacttattaatcttcttatacaaatggatctgtctctctgcatggcaaaatacttacactaattttattttctttgtttgataacaaatttatcggctaagcatcacttaaatttaatacacgttatgaagactaaaaccacgtcacactataagaaccttacaggctgtcaaacacccttccctacccactcacatctctccacgtggcaatctttgatattgacaccttagccactacagctgtcacactcctctctcggtttcaaaacaacatctctggtataaatacctctgtatatctttataaacccca

SEQ ID NO: 786 - DNA, 984 bp, Arabidopsis thaliana; identical to SEQ ID NO: 101
  misc_feature: T1 Mature Plant Expression:  GFP expression observed in the Abscission zone (Ab), Cortex (Cr), Epidermis (Ep) and Guard cells (Gc) of the flower, the Guard cells (Gc) of the pedicle, and pre-fertilized silique
  misc_feature: T1 Mature Plant Expression:  GFP expression observed in the Abscission zone (Ab) and Carpel (Ca) of the mature silique, the Cortex (Cr) and Epidermis (Ep) of the carple, the Mesophyll (Me), Vasculature (Vs) and Epidermis (Ep) of the leaf
  misc_feature: T2 Seedling Expression:  GFP expression observed in the Root hair (Rh) and Root transition (Rt) of the Hypocotyl (Hy)
  misc_feature (1)..(984): Ceres Promoter construct YP0015 as found in Promoter Report #116

SEQ ID NO: 787 - DNA, 970 bp, Arabidopsis thaliana; identical to SEQ ID NO: 105
  misc_feature: T1 Mature Plant Expression:  GFP expression observed in the Vascular (Vs) of the Petal (Pe) in immature and mature flowers, the Guard cells (Gc) of immature flowers
  misc_feature: T1 Mature Plant Expression:  GFP expression observed in the anther and pollen mother cells, the Pollen (Po) during attachment (foot), adhesion and hydration
  misc_feature: T1 Mature Plant Expression:  GFP expression observed in the Seed coat (Sc) of theovule, the mature Embryo (Em), the heart stage Embryo (Em) of the ovule
  misc_feature: T1 Mature Plant Expression:  GFP expression observed in the Embryo sack  (Es) of the pre-fertilized ovule, the Guard cells (Gc), Trichomes (Tc) and Epidermis (Ep) of the stem, the Guard cells (Gc ) of the leaf
  misc_feature: T2 Seedling Expression:  GFP expression observed in the Epidermis (Ep) and Guard cells (Gc) of the hypocotyl apex, the Guard cells (Gc), Vascular (Vs) and Mesophyll (Me) of the cotyledon
  misc_feature: T2 Seedling Expression:  GFP expression observed in the Epidermis (Ep) and Cortex (Cr) of the root transition zone, the Cortex (Cr) and Nucleus (Nu) of the root
  misc_feature (1)..(970): Ceres Promoter construct YP0230 as found in Promoter Report #118

SEQ ID NO: 788 - DNA, 999 bp, Arabidopsis thaliana
  misc_feature: T1 Mature Plant Expression:  GFP expression observed in the ovules of the pre-fertilized and fertilized silique, the Outer integument (Oi) of the fertilized ovule, the maturing seed, the Seed coat (Sc) of the mature seed
  misc_feature (1)..(999): Ceres Promoter construct YP0120 as found in Promoter Report #119
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcatttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcattctagagttactactatggagacaaaagtcgaataaaagagacctcacgtgaaaatgttacgagctagtaaaaaaagcatttacactaacggtaaaaaaagtatctataaatgtttacacaaggtagtagtcatt

SEQ ID NO: 789 - DNA, 989 bp, Arabidopsis thaliana
  misc_feature: T1 Mature Plant Expression:  GFP expression observed in the Epidermis (Ep) and Vasculature (Vs) of the Petal (Pe)
  misc_feature: T2 Seedling Expression:  GFP expression observed in the Epidermis (Ep) and Guard cells (Gc) of the rosette leaf primordia
  misc_feature (1)..(989): Ceres Promoter construct YP0261 as found in Promoter Report #120
  misc_feature (480)..(480): n is a, c, t, g, unknown, or other
ttgtaaattagttttatcgtagaagtaccaaatcaagtgattcaatggttaaattaaggtattaagttacatttgatatttaaaagtatccagaccttcattatagctcataagggttaaaattttgtcgttcttttgtatattcatggcaagctctaattcatgactaagtcacatttttcaaatatgtttttagtttttacttatgttggtaattagtggatttatagttaagttaaaaagttggcgagttctagctttgaaactcatttagaaatatatatatatatatatatattcaattttagtaaattgttaatctattctaatggtgtaactgtaacaaatgagaatgaaaaaaatatactattgtgaataaaaccccacacaacacattactataataagttaaacttctttttttataggcgcctggaaaaaaaagaaaagcaacaagagggstgtgaggacgcatcaccnggtttcgtagcacacatgtgcatttgtctctttgctttttcggtttttttcttgccaatcaatttattttgttcctcagaaaaaagaaaatctaaaaccaaaatatatattataacctcatttaataaacaacaaaaatgtttgttgaaaaaaaaaaagtttttatttatcttgaccttatttctttgaagaaaataaagcttggttattaaagaagtccaagttagttgccaccatcagtggcataacggtaaattaaagccaacttcctctaactaaagttttctataaattcaaccactcacctcccactctaaaacccaacaacataatttcacatatctctctttctttctcttgaaggaaagacgaagatctccaagtcccaagtacgtaactactttctccatctacattcaattgtttctccttaatttctctagtacatatttacttgtgctataagtaattgattttatatcacccatgtgcaggttgttaacacaaga

SEQ ID NO: 790 - DNA, 911 bp, Arabidopsis thaliana
  misc_feature: T1 Mature Plant Expression:  GFP expression observed in the Vasculature (Vs) of the inflorescence meristem and the Pedicel (Pd) and Receptacle, the Medial vasculature (Mv) of the leaf, the stem, the Medial vasculature (Mv) of the immature and mature
  misc_feature: T1 Mature Plant Expression:  GFP expression observed in the Vasculature (Vs) of the Anther (An),  Abscission zone (Az), Filament (Fi), Carpel (Ca), Filament (Fi), Funiculus (Fn), Ovule (Ov), Placenta (Pl), Root cap (Rc), Sepal (Se), Silique (Si)
  misc_feature: T2 Seedling Expression:  GFP expression observed in the Epidermis (Ep) of the Rosette leaf (Rl) of the seeding, the Cortex (Cr) of the root, the vasculature of the seedling and cotyledon, the root tip
  misc_feature (1)..(911): Ceres Promoter construct YP0263 as found in Promoter Report #121
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaccgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcgtgctagcatttttcattttcccttcatttgtggataacgcacgatataacattctacacaccaacaagattctataaaaacgcaaaggttgtctccatagaatatcgtc

SEQ ID NO: 791 - DNA, 863 bp, Arabidopsis thaliana
  misc_feature: T1 Mature Plant Expression:  GFP expression observed in the Guard cells (Gc) of the flower, pedicel and silique, the Vasculature (Vs) of the mature embryo and the cotyledons
  misc_feature: T2 Seedling Expression:  GFP expression observed in the Root hair (Rh) of the Hypocotyl (Hy) and the root transition zone, the Epidermis (Ep) of the upper and lower Root (Rt), the Vascular (Vs) of the lower root
  misc_feature (1)..(863): Ceres Promoter construct YP0003 as found in Promoter Report #123
tggatctgctagatatatgagaacgaaagaaccagaagctattagaggcgggaggagatatgtggggatgatttcagtgcaattccacgacgcaccatttccactttcgtaacacctaaacgaccgcttcggccgtataaaatcgcaaatgtttggtctcagtgtatttttccaatttccaaatacatcaattcaaattatataatatctagtggcaattataagtatatcatatattttcaaaattaattaaaaagattactaaattatgtttgactacaactattataatagttaaaaacataaacaaaaacaaagaaactattttaataaaaaaatcaagtaaacattaaaacataagcaaaaaataatgttaaagaaattattaattattaatttactaataattaatacctctataaattaattgttagaggtttaacgtaatttataaggaaaactaaagaagactttaacccataaagaaaaaaacaaagactgaattgaaggcccatatttagaagaagagaaagaagacccaaatatgatataaaatccagcccatttatatatttttattttgtttctggaaggaaaataagaaaatggcaaaaacgaaataatctgaaaaagtaaggtcttttaccaaaaaggatattttttttataaacagagcataaagttttcacttttcttctgctcctttctcgtctctgtcttcttcgtcctcattcgttttaaagcatcaaaatttcatcaacccaaaatagattaaaaaaatctgtagctttcgcatgtaaatctctctttgaaggttcctaactcgttaatcgtaactcacagtgactcgttcgagtcaaagt

SEQ ID NO: 792 - DNA, 1000 bp, Arabidopsis thaliana
  misc_feature: T1 Mature Plant Expression:  GFP expression observed in the Pedicel (Pd) of the inflorescence meristem and the flower, the tem below the inflorescence meristem, the Stigma (Sg) of the flower
  misc_feature: T1 Mature Plant Expression:  GFP expression observed in the Petal (Pe) of the flower, the Style (Sy) and Carpel (Ca) of the silique, the Outer integument (Oi) of the ovule, the Epidermis (Ep) of the stem
  misc_feature: T2 Seedling Expression:  GFP expression observed in the Epidermis (Ep) of the hypocotyl, the root transition zone, the cotyledon and the rosette, the Trichomes (Tc) of the rosette leave and trichome base cells
  misc_feature (1)..(1000): Ceres Promoter construct YP0356 as found in Promoter Report #125
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaatttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 793 - DNA, 1000 bp, Arabidopsis thaliana
  misc_feature: T1 Mature Plant Expression:  GFP expression observed in the Chalaza (Ch), Funiculus (Fn) and Outer integument (Oi) of the ovule primordial, the Chalaza (Ch) in the pre-fertilized ovule
  misc_feature: T1 Mature Plant Expression:  GFP expression observed in the Chalaza (Ch) and Micropyle (Mp) of the fertilized ovule and developing seed, the Chalaza (Ch) of the mature seed
  misc_feature: T2 Seedling Expression:  GFP expression observed in the Epidermis (Ep) of the seedling root, the Vascular (Vs) of the Hypocotyl (Hy) and root transition zone, the Vascular (Vs) and Pericycle (Pr) of the root
  misc_feature (1)..(1000): Ceres Promoter construct YP0374 as found in Promoter Report #126
aagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttg

SEQ ID NO: 794 - DNA, 998 bp, Arabidopsis thaliana
  misc_feature: T1 Mature Plant Expression:  GFP expression observed in the Petal (Pe), and Sepal (Se) of the flower, the flower bud
  misc_feature: T2 Seedling Expression:  GFP expression observed in the Epidermis (Ep), Vasculature (Vs) and Guard cells (Gc) of the seedling apex, the Vasculature (Vs) of the Cotyledon (Co) petiole, Hypocotyl (Hy) and root
  misc_feature: T2 Seedling Expression:  GFP expression observed in the Epidermis (Ep) of the root and  Cotyledon (Co) petiole
  misc_feature (1)..(998): Ceres Promoter construct YP0377 as found in Promoter Report #127
tataaaccattcctataacaccatatttaaacataacaatgaattgcttggatttcaaactttattaaatttggattttaaattttaatttgattgaattatacccccttaattggataaattcaaatatgtcaactttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaaccgctggcaaccacttttgccgcgtttaatttctttctgaggcttatataaatagatcaaaggggaaagtgagatataatacagacaaaacaagagaaaaga

SEQ ID NO: 795 - DNA, 999 bp, Arabidopsis thaliana
  misc_feature: T1 Mature Plant Expression:  GFP expression observed in the Flower (Fl),  of the inflorescence meristem, the Silique (Si), Stamen (St), Petal (Pe), and Sepal (Se) of the immature flower, the Silique (Si), Sepal (Se) and Receptacle (Re) of the mature
  misc_feature: T1 Mature Plant Expression:  GFP expression observed in the Anther (An), the Valve margin (Vm) of the silique, the Funiculus (Fn) of the placenta and mature ovule
  misc_feature: T1 Mature Plant Expression:  GFP expression observed in the ovule primordial and developing ovule, the Trichome (Tc), Epidermis (Ep), Nucleus (Nu) and Guard cells (Gc)
  misc_feature: T1 Mature Plant Expression:  GFP expression observed in the Epidermis (Ep), Mesophyll (Me) and Guard cells (Gc) of the abaxial leaf, the Mesophyll (Me) of the adaxial leaf, the Cortex (Cr), Epidermis (Ep) and Guard cells (Gc) of thestem
  misc_feature: T2 Seedling Expression:  GFP expression observed in the seedling, seedling apex, hypocotyl, cotyledon and root, the Rosette leaf (Rl), the Root (Rt),, the Mesophyll (Me), Epidermis (Ep) and Guard cells (Gc) of the leaf
  misc_feature (1)..(999): Ceres Promoter construct YP0380 as found in Promoter Report #128
acaagtaccattcacttttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 796 - DNA, 1000 bp, Arabidopsis thaliana
  misc_feature: T1 Mature Plant Expression:  GFP expression observed in the Pedicel (Pd) of the inflorescence meristem, the lateral and medial Nectary (Ne) in the flower, the modified stomata opening in the lateral nectary
  misc_feature: T2 Seedling Expression:  GFP expression observed in the Vasculature (Vs) of the Hypocotyl (Hy) and root
  misc_feature (1)..(1000): Ceres Promoter construct YP0381 as found in Promoter Report #129
cacggtcaaagtattgctaacatggtcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggct

SEQ ID NO: 797 - DNA, 999 bp, Arabidopsis thaliana
  misc_feature: T1 Mature Plant Expression:  GFP expression observed in the Nectary (Ne) of the flower, the Vasculature (Vs) of the Sepal (Se)
  misc_feature: T2 Seedling Expression:  GFP expression observed in the Vasculature (Vs) of the cotyledon and Rosette leaf (Rs), the Epidermis (Ep) and Root hair (Rh),  of the root, the seedling root and root cap
  misc_feature (1)..(999): Ceres Promoter construct YP0382 as found in Promoter Report #130
gcaaacaataatttatcgtaagagtttttttaaaattcgttggaacttggaagggattttaaatattattttgttttccttcatttttataggttaataattgtcaaagatacaactcgatggaccaaaataaaataataaaattcgtcgaatttggtaaagcaaaacggtcgaggatagctaatatttatgcgaaacccgttgtcaaagcagatgttcagcgtcacgcacatgccgcaaaaagaatatacatcaacctcttttgaacttcacgccgttttttaggcccacaataatgctacgtcgtcttctgggttcaccctcgttttttttttaaacttctaaccgataaaataaatggtccactatttcttttcttctctgtgtattgtcgtcagagatggtttaaaagttgaaccgaactataacgattctcttaaaatctgaaaaccaaactgaccgattttcttaactgaaaaaaaaaaaaaaaaaactgaatttaggccaacttgttgtaatatcacaaagaaaattctacaatttaattcatttaaaaataaagaaaaatttaggtaacaatttaactaagtggtctatctaaatcttgcaaattctttgactttgaccaaacacaacttaagttgacagccgtctcctctctgttgtttccgtgttattaccgaaatatcagaggaaagtccactaaaccccaaatattaaaaatagaaacattactttctttacaaaaggaatctaaattgatccctttcattcgtttcactcgtttcatatagttgtatgtatatatgcgtatgcatcaaaaagtctctttatatcctcagagtcacccaatcttatctctctctccttcgtcctcaagaaaagtaattctctgtttgtgtagttttctttaccggtgaattttctcttcgttttgtgcttcaaacgtcacccaaatcaccaagatcgatcaaaatcgaaacttaacgtttcagaaga

SEQ ID NO: 798 - DNA, 1000 bp, Arabidopsis thaliana
  misc_feature: T1 Mature Plant Expression:  GFP expression observed in the Guard cells (Gc) and Seed coat (Sc) of the inflorescence meristem, the Stamen (St) of the flower, the Seed coat (Sc) of the developing seed
  misc_feature: T1 Mature Plant Expression:  GFP expression observed in the Chalaza (Ch) and Outer integument (Oi) of aborted ovules, the Guard cells (Gc) and Vasculature (Vs) of the leaf
  misc_feature: T2 Seedling Expression:  GFP expression observed in the Epidermis (Ep) of the seedling root
  misc_feature (1)..(1000): Ceres Promoter construct YP0388 as found in Promoter Report #131
agaagtattcacgcaccaaggttatatttgtagtgacatattctacaattatcacatttttctcttatgtttcgtagtcgcagatggtcaattttttctataataatttgtccttgaacacaccaaactttagaaacgatgatatataccgtattgtcacgctcacaatgaaacaaacgcgatgaatcgtcatcaccagctaaaagcctaaaacaccatcttagttttcactcagataaaaagattatttgtttccaacctttctattgaattgattagcagtgatgacgtaattagtgatagtttatagtaaaacaaatggaagtggtaataaatttacacaacaaaatatggtaagaatctataaaataagaggttaagagatctcatgttatattaaatgattgaaagaaaaacaaactattggttgatttccatatgtaatagtaagttgtgatgaaagtgatgacgtaattagttgtatttatagtaaaacaaattaaaatggtaaggtaaatttccacaacaaaacttggtaaaaatcttaaaaaaaaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagttttgatctgcccgttcaaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaatagttttgacgatca

SEQ ID NO: 799 - DNA, 1000 bp, Arabidopsis thaliana
  misc_feature: T1 Mature Plant Expression:  GFP expression observed in the Style (Sy) of the Silique (Si), the Anther (An), Petal (Pe) and Sepal (Se) of the flower, the anther locules
  misc_feature: T1 Mature Plant Expression:  GFP expression observed in the Outer integument (Oi) of the normal Ovule (Ov) and aborted ovule, the Hydathode (Hd) and Vasculature (Vs) of the leaf
  misc_feature: T2 Seedling Expression:  GFP expression observed in the Epidermis (Ep)of the root
  misc_feature (1)..(1000): Ceres Promoter construct YP0396 as found in Promoter Report #133
catagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataac

SEQ ID NO: 800 - DNA, 1000 bp, Arabidopsis thaliana
  misc_feature: T1 Mature Plant Expression:  GFP expression observed in the Filament (Fi)
  misc_feature (1)..(1000): Ceres Promoter construct PT0506 as found in Promoter Report #135
aggacttccactactctttcccacacgctccagaccactgtttgctttcctctgattaaccaatctcaattaaactactaatttataattcaagataattagataaccaatcttaaaatttggaatcttcttccctcacttgatattacaaaaaaaaaactgatttatcatacggttaattcaagaaaacagcaaaaaaattgcactataatgcaaaacatcaattaattacattcgattaaaaaatcatcattgaatctaaaatggcctcaaatctattgagcatttgtcatgtgcctaaaatggttcaggagttttacatctaatcacataaaaagcaaacaataaccaaaaaaattgcattttagcaaatcaaatacttatatatatacgtatgattaagcgtcatgactttaaaacctctgtaaaattttgatttatttttcgatgcttttattttttaaccaatagtaataaagtccaaatcttaaatacgaaaaaatgtttctttctaagcgaccaacaaaatggtccaaatcacagaaaatgttccataatccaggcccattaagctaatcaccaagtaatacattacacgtcaccaattaatacattacacgtacggccttctctcttcacgagtaatatgcaaacaaacgtacattagctgtaatgtactcactcatgcaacgtcttaacctgccacgtattacgtaattacaccactccttgttcctaacctacgcatttcactttagcgcatgttagtcaaaaaacacaaacataaactacaaataaaaaaactcaaaacaaaacccaatgaacgaacggaccagccccgtctcgattgatggaacagtgacaacagtcccgttttctcgggcataacggaaacggtaaccgtctctctgtttcatttgcaacaacaccatttttataaataaaaacacatttaaataaaaaattattaaaacctcaaaaaatctctgtttcttgttta

SEQ ID NO: 801 - DNA, 1000 bp, Arabidopsis thaliana
  misc_feature: T1 Mature Plant Expression:  GFP expression observed in the Anther (An) and Vascular (Vs) of the anther
  misc_feature: T2 Seedling Expression:  GFP expression observed in the root and Vascular (Vs) of the Pedicle (Pd)
  misc_feature (1)..(1000): Ceres Promoter construct PT0511 as found in Promoter Report #136
tttaattttgattctaaagagttgtgacgggtcatcacagattcttcgtttttttatagatagaaaaggaataacgttaaaagtatacaaattatatgcaagagtcattcgaaagaattaaataaagagatgaactcaaaagtgattttaaattttaatgataagaatatacatctcacagaaatcttttatttgacatgtaaaatcttgttttcacctatcttttgttagtaaacaagaatatttaatttgagcctcacttggaacgtgataataatatacatcttatcataattgcatattttgcggatagtttttgcatggggagattaaaggcttaataaagccttgaatttccgaggggaggaatcatgttttatacttgcaaactatacaaccatctgcatcgataattggtgttaatacatgcaaggattatacactaaaacaaatcatttatttccttacaaaaagagagtcgactgtgagtcacattctgtgacaaggaaaggtcaagaaccatcgcttttatcatcattctctttgctaacaacttacaaccacacaaacgcaagagttccattctcatggagaagaacatattatgcaaaataatgtatgtcgatcgatagagaaaaggatccacaattattgctccatctcaaaagcttctttagtacacgatacatgtatcatgtaaatagaaatatgaaagatacaatacacgacccattctcataaagatagcaacatttcatgttatgtaaagagtcttccttaggacacatgcattaaaactaaggattaccaacccacttactcctcactccaaccaaatatcaatcatctattttgggtccttcactcataagtcaactctcatgccttcctctataaataccgtaccctacgcatcccttagttctacatcacataaaaacaatcatagcaaaaacatatatcctcaaattaattagatctcatctatctctaccctcga

SEQ ID NO: 802 - DNA, 999 bp, Arabidopsis thaliana
  misc_feature: T1 Mature Plant Expression:  GFP expression observed in Guard Cells (GC) that define the stomate
  misc_feature (1)..(999): Ceres Promoter construct YP0262 as found in Promoter Report #141
tacttcgtaaggttaatatatgatatagtgggcctgacaaaaaatcatatgggcttgacaaaatctatgtttatatccagttcggtccaaaattcgaaaacataaacaatgtggaaagatgtgttggctaatctgataccatgtcaaaaaaacatagaagttcttgtgaggtttcttgtttattcatgtggaggcaattgcccttgtatacaaggcttgtgaaagaagtaaagaagataagtttaggaagaaggtggcccatgagggcccaatattcatatcattagtgaaaagcataggaatttcaacttgtaatattaaaatcagtgataattgaataacattaatctttttaagatttccaaattaattcaaatcttcattaagaaataagatttaggaatactaaaaagctaaataattatctaattacttaaaatcagtaatgaaaattaatattatactcccatagtatattttcttcactatgaatgaagttgagacttcaattttgacaaattcggtgttctggaataacaaaagaagtcaaagaaagaaaattagggagatagagtaaattaaagttgagacaaatcagcttcattttgtttttcccaaataataatatacagatagatctttcggccccggcgcattctctagatttgctcatcaccacctcgaaatttctgctcgaagttctccaaaacagttcattcatctacatttaccagatcatattcgtattcagtcgtctctaaattctcactaaatcaatccttcctttggataattccggtgtttgcgaggaatctgttgaaatgattggttagttcagttaaactctacttctaaaactaaatctgcattcaaatgtagtctctagttctcgtacttgaagtagacttgattcgatttgatttactgattcgtggcttttgatttcacaggtcaattggaaatctgagaatccgtgtgactattattgcagctggatcg

SEQ ID NO: 803 - DNA, 999 bp, Arabidopsis thaliana
  misc_feature: T2 Seedling Expression:  GFP expression observed in the seedling root, Epidermis (Ep), Root cap (Rc) and Root hair (Rh) of the root
  misc_feature (1)..(999): Ceres Promoter construct YP0275 as found in Promoter Report #142
aaacattaatatgtagtaactatgggcgtatgctttactttttaaaatgggcctatgctataattgaatgacaaggattaaacaactaataaaattgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcacttttaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 804 - DNA, 1000 bp, Arabidopsis thaliana
  misc_feature: T2 Seedling Expression:  GFP expression observed in the Epidermis (Ep) and Root hair  (Rh) of the seedling root
  misc_feature (1)..(1000): Ceres Promoter construct YP0337 as found in Promoter Report #143
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagttttcttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaattaaaaa

SEQ ID NO: 805 - DNA, 999 bp, Arabidopsis thaliana
  misc_feature: T2 Seedling Expression:  GFP expression observed in the seedling Root (Rt), the Epidermis (Ep) of the root
  misc_feature (1)..(999): Ceres Promoter construct YP0384 as found in Promoter Report #144
tttaaaaaattggataaaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaacca

SEQ ID NO: 806 - DNA, 1000 bp, Arabidopsis thaliana
  misc_feature: T1 Mature Plant Expression:  GFP expression observed in the Stem (Sm) of the inflorescence meristem, the Pedicel (Pd), the Cortex (Cr) of the Pedicel (Pd), the Epidermis (Ep) and Guard cell (Gc) of the stem
  misc_feature: T2 Seedling Expression:  GFP expression observed in the root transition zone of the Hypocotyle (Hy), the Epidermis (Ep) of the lower root
  misc_feature (1)..(1000): Ceres Promoter construct PT0535 as found in Promoter Report #145
tatcattattgtactgcctgtcaattttttgattgtatcttttattcagcagcatcacattctccttcagtgtccttctcttcttttctttttcttttctttttctttcctcattaaacccatacaattctacggtaaatattatggatttgcatacaaactctctaattgtttgtttgggtactataatatggggtccctataatatgtgtagcttaactttaagatagaactaagtcaacaagatccggagacaccatgtcaaagttctatgttcttatgattagatgaacaaagttatgatttattcaagattatcacgattcgaactagttctaaacttgtaaacgtaaaataataaataacgtttgcaactacaacactgaacataaattaatgaagtttgcttgatgtgttggttaaaatttggaatgggacaataaaaagaagaagagaactgagagaagtggtgggggaagtgggaaccttaacttccccacgtgacactaacgagcaacgttaattgaatagtagtaggccctttttgtagtacactcttttatatatggtcaccttttaattagtttgcaaatcacatacttttaaaatcataaaagcaattaacgttgctcgttggtgtcatatgcgattgtagttagtataatcgatcttaattaaaacaaagtccatattaaaaatgaccaaagtatgtaaaaataaaatgttgaattagcatatggtcactgatcttttctattttaagatttagtaaacctaagatgtatccgcaagcctatagggtttgatgtggattactactagttacttttgtatgggcttgaagaaacttcattgggccacaaagagggaggagtgagcgaagagcccaaattcaaacaaaaggatatgagggttcaaatgttattataaaatatattgtggccaatttgtaaagaaacttgataattactttaaaagccccaacacaattatctttaca

SEQ ID NO: 807 - DNA, 998 bp, Arabidopsis thaliana
  misc_feature: T1 Mature Plant Expression:  GFP expression observed in the Abscission zone (Az) between the Pedicel (Pd) and  Sepal (Se), the Abscission zone (Az) in the flower
  misc_feature: T2 Seedling Expression:  GFP expression observed in the Epidermis (Ep) of the seedling root
  misc_feature (1)..(998): Ceres Promoter construct YP0385 as found in Promoter Report #146
actcaacaataggacaagccaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 808 - DNA, 1000 bp, Arabidopsis thaliana
  misc_feature: T1 Mature Plant Expression:  GFP expression observed in the Guard cell (GC) of the flower
  misc_feature: T2 Seedling Expression:  GFP expression observed in the Epidermis (Ep) and Root hairs (Rh) of the seedling root
  misc_feature (1)..(1000): Ceres Promoter construct YP0371 as found in Promoter Report #147
gatatatttgtttaataatgcctacgattctgcgaagacaggagaagccatacctttcaatctaagccgtcaacttgttcccttacgtgggatcctattatacaatccaacggttctaaatgagccacgccttccagatctaacacagtcatgccttctacagtctgcaccccttttttttttagtgttttatctacattttttcctttgtgtttaattttgtgccaacatctataacttacccctataaaaatattcaattatcacagaatacccacaatcgaaaacaaaatttaccggaataatttaattaaagctggactataatgacaattccgaaactatcaaggaataaattaaagaaactaaaaaactaaagggcattagagtaaagaagcggcaacatcagaattaaaaaactgccgaaaaaccaacctagtagccgtttatatgacaacacgtacgcaaagtctcggtaatgactcatcagttttcatgtgcaaacatattacccccatgaaataaaaaagcagagaagcgatcaaaaaaatcttcattaaaagaaccctaaatctctcatatccgccgccgtctttgcctcattttcaacaccggtgatgacgtgtaaatagatctggttttcacggttctcactactctctgtgatttttcagactattgaatcgttaggaccaaaacaagtacaaagaaactgcagaagaaaagatttgagagagatatcttacgaaacaaggtatatatttctcttgttaaatctttgaaaatactttcaaagtttcggttggattctcgaataagttaggttaaatagtcaatatagaattatagataaatcgataccttttgtttgttatcattcaatttttattgttgttacgattagtaacaacgttttagatcttgatctatatattaataatactaatactttgtttttttttgttttttttttaatacatattttgcttttggaagatca

SEQ ID NO: 809 - DNA, 1000 bp, Arabidopsis thaliana
  misc_feature: T1 Mature Plant Expression:  GFP expression observed in the flower, the silique, the pre-fertilized silique, the fertilized silique, the leaf, the stem
  misc_feature (1)..(1000): Ceres Promoter construct PT0610 as found in Promoter Report #148
ttagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcacttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattcca

SEQ ID NO: 810 - DNA, 1000 bp, Arabidopsis thaliana
  misc_feature: T1 Mature Plant Expression:  GFP expression observed in the flower bud, pedicel and silique
  misc_feature: T2 Seedling Expression:  GFP expression observed in the seedling, the root transition zone, the rosette leaf, the lateral root, the root, lateral root initiation
  misc_feature (1)..(1000): Ceres Promoter construct PT0590 as found in Promoter Report #152
attattcaatttaataaaaattgagtcggccaatttaatgcgagacttctgtacaacgaccctaaaagtgggtttgataaatgaaacatattgcaacaaaaaaatactagtaataatgataaaatagtaacatgtcatggcgcattgaatatcctacgaaggtttagtgtttacttttaaaaaatcctaatatgatactagtacatatagctagcttgccttgcttatgctattgcatagtctgtattaataaatgatgttatacatttcgatagagtaacattttgggaacatgagtgaacgtgcttgaatcttcgtgcccttgacgtcagaagctagtaattttaaatactaattaacattcatacaaattaacagatacaatgtactatatcataattcgtttccgtaacacaacgcaacaatttgaaagtagatgtactttagtacttagttagtgtgcaccaaaaaaaaaagatgtagttagttagtaaggggttaaatgttttaatttattaagaaaacttaaattcattaaatgttagaaaaagtctaattagtttatattcgaacactgtgctcaaaattaaaaagtcaactattttagactatagagtttattaattaataataaattcgataaatcaccgtattattttcttcaacgacaagtagccgtgaagacacgggagcgaagagagataaacagaagatgaagaagaagatcaatgtcataatcttcagggagataaatccgtaatctttattaatcaaggttaatccttttttttttcttcatcttaattctttgcgtcttccttttctatttatcacgagatctgtctttctttttcctcttctttctctctcttctctctgaagacagtacttgtttctgtccggcgttaaaagcttcggtggtggtctcttgacttctctgagaagaagaaaaggaagctgagtctcattttagattcagctcacgaggaagtgacgacga

SEQ ID NO: 811 - DNA, 1000 bp, Arabidopsis thaliana
  misc_feature: T1 Mature Plant Expression:  GFP expression observed in the Guard cells (Gc) of the pedicel and leaf,, the Root apical meristem (RAM) and Suspensor (Su) of the late torpedo stage in the ovule, the Suspensor (Su) of the ovule
  misc_feature: T2 Seedling Expression:  GFP expression observed in the Guard cells (Gc) and Vasculature (Vs) of the seedling, the Vasculature (Vs)  of the cotyledon and root, the root transition zone, the Root Cap (Rc) of the root tip
  misc_feature (1)..(1000): Ceres Promoter construct PT0629 as found in Promoter Report #154
tttaagcatatcaaatgtgaaaattggtcttaggttatgatgtatatccttatatagtaaaagtatattagtctaaaaatttagatttaaaaagtgaactaaaatttaaaagcaagctgaattacataaatcaagtgacaattgtaatttgttgtgacatttgtaagttcataatggtacgtgtcacgctatgttaattaagtttgaaatatgagatgtaagaaaaaagtgatcaaaaattaagttcttttggagcgttaagtccaaaggtcaattagagcgcaatatcagtccagaaaagtggatgaaaaatgtccatccatccatcgagaaatatgcttaaagtaaacgcttacttttcaagcgaccttcacggtattgccgcagtcaaaaatacgcggcgactgtttggttggtatagtgacgacccactctcacgcggattcattaatttcctatcacaaataagaaaaaagaaacgtgaaattaatttgttaagtaacaaaaacaaaagaaaaaggaaactgacaagaaacgctaaagtggttccttccttgtactcaaaaaaacgttaatttacagctcagaataagtttttctgtttaccgtaatttcgacccaatatttttacgaataacaatttagtccaaaacctctttgatatattgcaatttaataccctaattaagtcttcttatctagtaatttggttttatttccatgacctacaatataagataatagtcattagtgctagatataaagactgaattagggtatataagatatatggaatgctaagattacaaagagatagagaatcaaaaaaaggaaagaattaaggggcaaatatgaaataattaaaaacaagggagccaaaggaacaatgtaagaaaagcaataaaattaaaaacaaaaccctcaaaaagaagaaagcggagactcgttagctttttcctgcctcctataaattgaacgcgacttgcagaacctttcctca

SEQ ID NO: 812 - DNA, 1000 bp, Arabidopsis thaliana
  misc_feature: T1 Mature Plant Expression:  GFP expression observed in the Endosperm (En) of the ovules at torpedo stage of the embryo and in mature ovules
  misc_feature: T2 Seedling Expression:  GFP expression observed in the Epidermis (Ep) of the seedling, hypocotyl, cotyledon and Root (Rt)
  misc_feature (1)..(1000): Ceres Promoter construct PT0642 as found in Promoter Report #160
ttgaacatccttaatttgaaccataaaaaatatgacattaactatctgattaattttcacttaagggatggttagttaagttacattggattaaaaatggtattagtagaccaattagaacatgtatgccattttttgtttacaaaaacctttttaagtggtatttataagacttgctcaatttcattcaaaagaacatgaaatggatggactagttttaatggcaataacccacacaattactcatatttggttcaacaaacttctatttcggttcacttattaattttccatctatatatgaatcatataatatgattaatttacacaagttcacacggccacgtaaaatgtaactgtcttcaagttgtgcacataaagagggtagtttcgaagataacgggtcaacgaaagggtaaaagagtaaattgcatagaacgcggccaaattaaaagcccccaattgggataaaagtcatcgccgtctcttaggtgtcaaatctcaactgtctaaaaacattaaaagcttcgttggggtagttgcatcttccctctctaatacaaaacttattttatccagttttagtttcgatttttcatttgttaacatgttttcatttttcttttaatgttaatagcctttttatttggaaaatgaaaacaatttcacaatttaattctaaattaccatttctaaaaaatagaaataatataaataataatattgaataatacatggactaaaaaattatagtactgtcctaaacaaaattgcttgactagattgaacagaaaatgtttttgatgtcttactagtttgaacaatttatttgctaacattattctctttgtatatttcttaaaaacccatattttttccttaaatatttcccatttcccctaactacattcaatagctaagtctctctctccctctctctttctctctcactcaaaaatttcccattaaattctcaaattttctccaactttttaggcca

SEQ ID NO: 813 - DNA, 1000 bp, Arabidopsis thaliana
  misc_feature: T1 Mature Plant Expression:  GFP expression observed in the inflorescence meristem, the inflorescence meristem, the flower, the stamen, the pre-fertilized silique, the unfertilized stigma
  misc_feature: T1 Mature Plant Expression:  GFP expression observed in the pre-fertilized ovule, the fertilized ovule, the developing seed, the developing seed, the early mature seed, the Seed coat (Sc), the seed coat, the embryo, the Leaf, the stem
  misc_feature: T2 Seedling Expression:  GFP expression observed in the leaf, the leaf, the seedling, the root tip
  misc_feature (1)..(1000): Ceres Promoter construct PT0623 as found in Promoter Report #161
aaagttattgacattttgaaaggaccgtaaatattaccaaaaaactgacggagttaggatcggccacgtagaaagggacaaagagagaacagtcacggactcggccagactaagtatgggcctgtctgaatccaaactcagctaagttccaaaagcataaagagagatgtgtaatgaaatgaacgtattctagaaacgaaagcaatgttatgctttgtttttgagccacatgtttttgggagatggagagaatcttttttacgtttttaacctaacccacttggcacttggccaaaaaagtgagaagaaactgtggcgaatgagtaggccacgccatggactttgttccttgtccttcaaaagttaaatttatgttatgcgtggggacaatctaagcaacgtggttcctttaaatatcgcagcttcctcttttacacttttggagcctacgtgttttgttttggaccggccaaatacacgagtcagtcagtttagaaataatttggatgtccaaaaatcttggagatccaaataaaataattagcatgttttagttcataagaatatgaaatgtagataaactgtctatattaatttttccatagaattggctttttatcgaggtgatgtacttaatgactttgttgattactactcgtataacaataaagaatatgatactatgtgagacttataatgaatttggtgtgtgttaattaatccagttgaaacagtttaataacaaatcagaataaaaattgtagtaagaaaatttgaacgctgatccttcaacctagatagtgaacctttcaaatactatatgattcacgtgtaatgtttttgaccgttggttatttttgtgtgaactatattaacttatcaatatcgaaaggctaaataagtaaataactaaaagaaagttcaggaaacaactcgacctaatgacctatcatttctgatcacccgtcctataaatacatacgtaagatcattcgttact

SEQ ID NO: 814 - DNA, 1000 bp, Arabidopsis thaliana
  misc_feature: T1 Mature Plant Expression:  GFP expression observed in the silique, the pollen, the embryo, the embryo, the stem,
  misc_feature: T2 Seedling Expression:  GFP expression observed in the Epidermis (Ep), Root hair (Rh), Cortex (Cr)  and Hypocotyl (Hy) in the root tip
  misc_feature (1)..(1000): Ceres Promoter construct PT0613 as found in Promoter Report #163
ttaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttc

SEQ ID NO: 815 - DNA, 1000 bp, Arabidopsis thaliana; identical to SEQ ID NO: 761
  misc_feature: T1 Mature Plant Expression:  GFP expression observed in Chalaza (Ch), Funiculus (Fn), Petals (Pe), Receptacle (Rc), Sepals (Se), Silique (Si), Stamen (St), Placenta (Pl), Micropyle (Mp).
  misc_feature: T2 Seedling Expression:  GFP expression observed in Cotyledons (Co), Hypocotyl (Hy), Root Hair (Rh), Vascular bundle (Vb), Vascular (Vs)
  misc_feature (1)..(1000): Ceres Promoter construct YP0093 as found in Promoter Report #261

SEQ ID NO: 816 - DNA, 1000 bp, Arabidopsis thaliana
  misc_feature (1)..(1000): Ceres Promoer construct YP0390 as found in Promoter Report #132
tccttgcatttattatagtgcctagatttttttttttttttttttgacattcagtgcctagaattttggtttatgtagatagaaaagtgacactcgacgcaaattcgaaagaatgccaccgaaaaaaatggaacgaatgatgtttcgctatgttggatgcttcagatcccatataacaacactactctcaaaattcataaactctcaaaacatattaatttagtagcatcacgaaaatacatgttgttctcaaatcattacaataacttctactcttattagctgaaaagtataaccttatgtttttgtaaaaagattgctaaacgttatatttgtatatcttttcagtttgttaatgtcattagaacgaagtgtaaaatcgcttcaagatttgttattctaaatgtattttagaacaaatattctgaacattaaattattttcaacaaaatttattttgaataacaaataacttgtcatggtcgtaactcttttttttcattctctagattgaatcaaaaataattttgttttgtagtataaaacatttttggtcttttattcaccgttttatagaacattaatatctcaagttctaatatgaaaacaaaaataactgatccctcaaaaaaaaggaagataaaggttgaaagacatgttattctcttcccaaaacaacctaatccaatacctctaaaaatttatctttctcacaatgccttcaaacaaattgtgttctttctatagttaacttgactatattaaaatctctaaagttaacttgacttctgaaacttgtgatctttctatagttaacttgactatattaaaatcttgagcaattaaaccattaaaaaaaaaaaaaacaggagaaaccttgaccaatacaacaaatcctaaaaatggccaacgataagaatcacaacagaaatttaaagactacatgtaactatttatactacagaaaacaccaaatagaatccaatcaaaaaaaaaaaaa

SEQ ID NO: 817 - DNA, 1000 bp, Arabidopsis thaliana
  misc_feature (1)..(1000): Ceres Promoer construct PT0681 as found in Promoter Report #176
gactttttttttatggagaacaaattatccagtagatgtttttttttattgctcagtaattgagaaatgggcacgaggatgaagatattccattgatgtgattccaatcttaataacattgcaatttcgtagctatataaatcatttcatgtgtaatattatccatcttgttaaattttctaatctctaaaatttcataccgtttgtgtttaacatagtttccgatccaatccaatccagcaaagtgaaataatttcgaatgataaggctgttttgcaaaatgccaaatatggcggaacaatttttatttaagaaacaagataaggattattaatgatcagatatgcttgatgaagttgtggtccattcttacttctcttctgcatatttatcacatcggtttctcattatctctatgcattcgggactactaatacaacaatagcacaaaaatacaacgtgacaacaaaaacaaccgagtagaaaactataaagacaacaacatttcaaattctctgttgccactaatactgaaaatccatttaaattttctttttgtgggttgaatttgcaccatataaaaatccaataatacaaaagaaagcaaatatacatgattggatattcttcgattatgatgtcgaacaacaacaattattaacatgtgtatagtttggcaaaaaatgaatatgaggtaaagagggctggacccattggccctataagcattaatgggcctgaaagcaacaacagaaattggaattaaataacgttgggtatctgtctgtcacatgcaacacagacaacttgagaatggatcaatcaacattcacgtgccatgatcctctcttcctcttattttgtctccttccaccaatcccatatctttctctattatacatctctaattatctcacttttaacatatagtttttttatacatctttaatgactatataaaccaaacactgatctttttcaggttgcgaataaaccaaga

SEQ ID NO: 818 - DNA, 1000 bp, Arabidopsis thaliana
  misc_feature (1)..(1000): Ceres Promoer construct PT0675 as found in Promoter Report #204
ttgtttaacacctcaaacctgttaagactaatcacaatgttcgaagataatgccatttctatatatatttagtatagcatcacacatgcgttctgtgttgcaaagtttactctagagttatcactgagtcatgactcatgatgaccattattatagtattagtacttttaagttttaggtcgagaatgtgaagctaatacatgcatgtaatgatgtaaatatgcctaccttaaaaaatatcgaattattcagaaacaatgactcgatatccgtaagaaaccgccagctcctgctgaattgcatgaacctatcttaatattctttcgccacgaactcttcccttttgtctccttcttataactctacacatcatcatttcttttccactaaataacttacaatacgtatacctttttcttttttgtcaatttaaatcaacactaagatatactttaaatacgaatcatttaaatgaatataatgtactaattgtttcagattttatttcctgtttaaaaatatactcatgaactaaaactaattaataaaatgtggataaattaaagccttttaacaaaaaaaaaatgtggataaattaatatcaatatgtttcctttttattttattttatctatttcaaaaaaataagttattcaatacatatgttgatattttgactatttttaatcataatttaaatcaattgttgtgttcttaagcaaaatatctaaaaacgaatataaccacgtccaccatagaagcactgcaattttagcattctaaaacatccttgatatttttttgtcaacgtcttattatcttttatctcagaccatgtatatggatgtatccactaacgcatatatatagagacaattaggcatctatcattttatcccacacttatctcttcctatctctctctcattcaaacccaaataggaaacaaatacacaaaagtataataaaaagtctttctctcatctttcgccacgtagac

SEQ ID NO: 819 - DNA, 1000 bp, Arabidopsis thaliana
  misc_feature (1)..(1000): Ceres Promoer construct PT0676 as found in Promoter Report #205
aagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 820 - DNA, 1000 bp, Arabidopsis thaliana
  misc_feature (1)..(1000): Ceres Promoer construct PT0698 as found in Promoter Report #234
gaagcatagattcttggatgtattcatattccttgctttaagtccttccgtctcaattttaacaactatggtcacatgtccatactgatctcgtaccatgcacttgtcttcacatgcttcttcattttctatttttgggtattcgacaaataaatcgtgcatggaaatgaatgtggtatcgtccaatgcagtttacgagataatacatatatttttatttttgttaaaaagtaataataatacacaattaataatatattattaccaaaaattataaacaaatattaattgcatgggatgaatttctggttgttgatttgttggttcagactaggtttgtattcactagagaacttcaaatatgctgaaattcgaccactcaaaagcaagtgagactctaattgtcaagggaaatagaagacgctttaagatcggatcgttgaggattagcttgcatgaagtctgaagatatcttcaagaagggactttgggttgggtccgccatggtagtgtttttgtgacttacaccgaaaatctttaattatatggaggaatagtaaatcttgctaagtaatcccgttaacttattaattgaatatatttttatgttaataatatttgtcctaaacgaaaagtatatctatttctctaatcatcaaataaaacaatgagtataagatacttacatatttaatttgtttttcttgatcttaaattagaattattaattgattcttttagtttcaaatatcatgcaaatatagatggcaaaagattcgagcatataaatatggtacttcaaattgtgaaagtacgatttgattttctcttttctttgttgtacgtatgatattaaaagtagaggaatatgattcttgagtgtagaatcttgccttctaccatggttcaagtgtaagcaatataaaaaagggagatgtgtgtttatttcttcccaactttgatactcacaagacatctttttaattcactcccttgcaaa

SEQ ID NO: 821 - DNA, 1000 bp, Arabidopsis thaliana
  misc_feature (1)..(1000): Ceres Promoer construct PT0708 as found in Promoter Report #235
gtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 822 - DNA, 1000 bp, Arabidopsis thaliana
  misc_feature (1)..(1000): Ceres Promoer construct PT0710 as found in Promoter Report #236
tagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaa

SEQ ID NO: 823 - DNA, 1000 bp, Arabidopsis thaliana
  misc_feature (1)..(1000): Ceres Promoer construct PT0721 as found in Promoter Report #237
aaagaagaaaaagtgtacacatgtttttgtccagccccattaccaatataccgatctggatatcatctagctcacatttcatgataaaagcaaactcagatggaatgtgtgtactgggctttattgggctaaacttgaactgagctttttatttttaaaaataaataaaagaaacaacaaggccgatgattttttcttaggtctaaaaagtctaaagtaaacccatttgtattgttttgtatataatattatataatttacaaaaatattgaaacgagtagttctgatattttgtttctatactttgacatgttttcgtgcacaaagttcctcagttttttttcccaaacaacaaccatttcagaaaatctttcttcttagaaattttatttcccaatttgaatagaaatatagatggaatggaaggcaacgacttgaaataataaagataaggttggacatctaaagcccataaaacaaagctaatccatgtaccattgtcatccacaaagcgtctccacctaaagcccattttggatccaaaattaaatttatttgtaagaaacaatatttctattttgtcattttacttgctgatcaagagtcgaaaaagatgcacgaaaagaaacatacacaagcgaacacaatataactaacactaataggtaatagtttctgacacgtgtaggcataataattggtggctacgtccctgcggcggttgcagtaacgataaacactccaccactaagagcgtctcatcacacgcgccaatttcactcttacgatggagataatgggcgagtgggatagtgtatcacgtgacattcgcagacacaactcgcttcataactgaaaaaattaataataaaaaatggatatgtttgtctttctctaatgtttcatgaacatctgtaacgtcaaacccactttaaaagctctgctttttgtgtttgtttttgcttactctcaaagaaagtggttcaatctctcgatttcc

SEQ ID NO: 824 - DNA, 1001 bp, Arabidopsis thaliana
  misc_feature (1)..(1001): Ceres Promoer construct PT0740 as found in Promoter Report #238
tgtggccactaaagatttacccttaaccgggcccatataagcccacgtcaagtggcgcttatacgctctccgtaagagagccaacatttggtatgtaatgttgcaaattattcttcaagacaataaattcaaatataattcaatattgtccaaatatagtgatgtacttcagttgtgcacatagaaactccactaaaccaacttttagatagatgcattcacaaattttcaacaatgtcgcgaaagtctaatccatcaccagattctaacattttaattattatatttaactatacatactctaatcagcatgagtcaaacgtgtacaatagcccaagcatataataagaccaaagtcaaactcaaataaatgtctccaaactcaaaacttgaaaaagacctaattattacatggtagatatgactttgtcgacaagtaaaccaactaatcctcgaagctaccttctcttcccagttattatgtgtgatcgatttataaatctcttcttctaataacacctatatttttcttatgatgtgaataaatataaaacttttaactttaaaacatatttatccgaaatattgcacttagatttcaaatagataaataatagtactatctaactgatattgaaaagacctaacacggaaaacagttttataaaaaatcccaaatgtgggtaattatcttgatttcttgggggaaacagaaaatggattaagattaatcggagtcgtgtcaagcagctcgttaataactgtagcaagttgactgagtaagcatcaacgtgtcatctccgtaaagcccattatttctagtctcgccgcgtcttctcttccacgtagcacttcactttttctctccttttgtttcctttggaacacaaacgtttctatttataggaataattacgtcgtccgtatctgtgtcggaacatagatccaaattaaaagcgacttacttaattacatatcgttcgtgtttttttcttcaaaaa

SEQ ID NO: 825 - DNA, 1000 bp, Arabidopsis thaliana
  misc_feature (1)..(1000): Ceres Promoter construct YP0286 as found in Promoter Report #111
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatatatatatctatgattaagtgtgtatgacataagaaactaaaatatttacctaaagtccagttactcatactgattttatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 826 - DNA, 1000 bp, Arabidopsis thaliana
  misc_feature (1)..(1000): Ceres Promoter construct YP0289 as found in Promoter Report #112
atggacttttcttctattatatggtcaaacaattactgctcaatgtatttgcgtatagagcatgtccaataccatgcctcatgatgtgagattgcgaggcggagtcagagaacgagttaaagtgacgacgttttttttgttttttttgggcatagtgtaaagtgatattaaaatttcatggttggcaggtgactgaaaataaaaatgtgtataggatgtgtttatatgctagacggaaaaatagttactcaactaatacagatctttataaagagtatataagtctatggttaatcatgaatggcaatatataagagtagatgagatttatgtttatattgaaacaagggaaagatatgtgtaattgaaacaatggcaaaatatatagtcaaatcaaactggtttctgataatatatgtgttgaatcaatgtatatcttggtattcaaaaccaaaacaactacaaccaatttctttaaaaaaccagttgatctaataactacattttaatactagtagctattagctgaatttcataatcaatttcttgcattaaaatttaaagtgggttttgcatttaaacttactcggtttgtattaatagactttcaaagattaaaagaaaactactgcattcagagaataaagctatcttactaaacactacttttaaagtttcttttttcacttattaatcttcttttacaaatggatctgtctctctgcatggcaaaatatcttacactaattttattttctttgtttgataacaaatttatcggctaagcatcacttaaatttaatacacgttatgaagacttaaaccacgtcacactataagaaccttacaggctgtcaaacacccttccctacccactcacatctctccacgtggcaatctttgatattgacaccttagccactacagctgtcacactcctctctcggtttcaaaacaacatctctggtataaatacctctgtatatctttataaacccca

SEQ ID NO: 827 - DNA, 1000 bp, Arabidopsis thaliana
  misc_feature (1)..(1000): Ceres Promoter construct YP0356 as found in Promoter Report #125
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaagttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 828 - DNA, 1000 bp, Arabidopsis thaliana; identical to SEQ ID NO: 793
  misc_feature (1)..(1000): Ceres Promoter construct YP0374 as found in Promoter Report #126

SEQ ID NO: 829 - DNA, 919 bp, Arabidopsis thaliana
  misc_feature (1)..(919): Ceres Promoter construct YP0377 as found in Promoter Report #127
tataaaccattcctataacaccatatttaaacataacaatgaattgcttggatttcaaattcaaatatgtcaactttttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgacacgcggccaaacctttttataatcatgctatttatttccttcttctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaactgctggcaaccacttttgccgcgtttaatttctttctgaggcttatataaatagatcaaaggggaaagtgagatataatacagacaaaacaagagaaaaga

SEQ ID NO: 830 - DNA, 1000 bp, Arabidopsis thaliana
  misc_feature (1)..(1000): Ceres Promoter construct YP0380 as found in Promoter Report #128
acaagtaccattcactctttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 831 - DNA, 1000 bp, Arabidopsis thaliana; identical to SEQ ID NO: 796
  misc_feature (1)..(1000): Ceres Promoter construct YP0381 as found in Promoter Report #129

SEQ ID NO: 832 - DNA, 1000 bp, Arabidopsis thaliana
  misc_feature (1)..(1000): Ceres Promoter construct YP0382 as found in Promoter Report #130
gcaaacaataatttatcgtaagagtttttttaaaattcgttggaacttggaagggattttaaatattattttgttttccttcatttttataggttaataattgtcaaagatacaactcgatggaccaaaataaaataataaaattcgtcgaatttggtaaagcaaaacggtcgaggatagctaatatttatgcgaaacccgttgtcaaagcagatgttcagcgtcacgcacatgccgcaaaaagaatatacatcaacctcttttgaacttcacgccgttttttaggcccacaataatgctacgtcgtcttctgggttcaccctcgttttttttttaaacttctaaccgataaaataaatggtccactatttcttttcttctctgtgtattgtcgtcagagatggtttaaaagttgaaccgaactataacgattctcttaaaatctgaaaaccaaactgaccgattttcttaactgaaaaaaaaaaaaaaaaaaactgaatttaggccaacttgttgtaatatcacaaagaaaattctacaatttaattcatttaaaaataaagaaaaatttaggtaacaatttaactaagtggtctatctaaatcttgcaaattctttgactttgaccaaacacaacttaagttgacagccgtctcctctctgttgtttccgtgttattaccgaaatatcagaggaaagtccactaaaccccaaatattaaaaatagaaacattactttctttacaaaaggaatctaaattgatccctttcattcgtttcactcgtttcatatagttgtatgtatatatgcgtatgcatcaaaaagtctctttatatcctcagagtcacccaatcttatctctctctccttcgtcctcaagaaaagtaattctctgtttgtgtagttttctttaccggtgaattttctcttcgttttgtgcttcaaacgtcacccaaatcaccaagatcgatcaaaatcgaaacttaacgtttcagaaga

SEQ ID NO: 833 - DNA, 1009 bp, Arabidopsis thaliana
  misc_feature (1)..(1009): Ceres Promoter construct YP0388 as found in Promoter Report #131
  misc_feature (1005)..(1005): n is a, c, g, or t
agaagtattcacgcaccttatatttgtagtgacatattctacaattatcacatttttctcttatgtttcgtagtcgcagatggtcaattttttctataataatttgtccttgaacacaccaaactttagaaacgatgatatataccgtattgtcacgctcacaatgaaacaaacgcgatgaatcgtcatcaccagctaaaagcctaaaacaccatcttagttttcactcagataaaaagattatttgtttccaacctttctattgaattgattagcagtgatgacgtaattagtgatagtttatagtaaaacaaatggaagtggtaataaatttacacaacaaaatatggtaagaatctataaaataagaggttaagagatctcatgttatattaaatgattgaaagaaaaacaaactattggttgatttccatatgtaatagtaagttgtgatgaaagtgatgacgtaattagttgtatttatagtaaaacaaattaaaatggtaaggtaaatttccacaacaaaacttggtaaaaatcttaaaaaaaaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagttttgatctgcccgttcaaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaatagttttgacgatcaccattgcanctgg

SEQ ID NO: 834 - DNA, 1026 bp, Arabidopsis thaliana
  misc_feature (1)..(1026): Ceres Promoter construct YP0396 as found in Promoter Report #133
  misc_feature (9)..(9): n is a, c, g, or t
  misc_feature (1022)..(1022): n is a, c, g, or t
ccagtcganttggcatagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataacccattgcanctgg

SEQ ID NO: 835 - DNA, 1000 bp, Arabidopsis thaliana
  misc_feature (1)..(1000): Ceres Promoter construct YP0337 as found in Promoter Report #143
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagtttttttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaatttaaaa

SEQ ID NO: 836 - DNA, 1013 bp, Arabidopsis thaliana
  misc_feature (1)..(1013): Ceres Promoter construct YP0384 as found in Promoter Report #144
  misc_feature (1009)..(1009): n is a, c, g, or t
tttaaaaaattggataacaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaaccaccattgcanctgg

SEQ ID NO: 837 - DNA, 995 bp, Arabidopsis thaliana
  misc_feature (1)..(995): Ceres Promoter construct YP0385 as found in Promoter Report #146
actcaagcaataggacaagcaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 838 - DNA, 1000 bp, Arabidopsis thaliana
  misc_feature (1)..(1000): Ceres Promoter construct PT0633 as found in Promoter Report #153
ttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaa

SEQ ID NO: 839 - DNA, 1000 bp, Arabidopsis thaliana
  misc_feature (1)..(1000): Ceres Promoter construct PT0564 as found in Promoter Report #156
aacaaaatagtcccgcaggttaaaacctagtattttacaaaaatatagacaaataaaataaaaatgaactatcgtggatttagttagagaaatccatacaaaaataaattgcattgagaaactttagatgacgactaagtaatataagattttgcattgagaaagcttacatgtcaccctaatttctatcaaaagggtttctgatactaattggaaccatgtgagaaactatccatagaaatgatgatcttatctagttatcatgagctgatgactttgaatattccacagtcactaaacgcatgtttatttctcagctttatgaatctgtatgtagacacactttcgtattttcttcacttttgtgtatttgtattgcccattcctcttttaccaaccaataaaaaaagcagtcttttttttgtttggtcaagcattggcactctttgtcaatcaattacccaagggatatataataataaattggaataatgaaagtagttcatcataaggttcgtgattattaacttctacttttgtttatattcaatagattaagatgccgtgtatgataaggagagcaaaagtaatccgatagagatcacagcaatattcattacaaaatagttttcaaataaaaacacatgatcaaaaagtgactcacaaaaacacatgatacgtacgtgggatgctaatcctaaagcaacaaggccacaagggcaaaatatgtagctttcatgctttggcaaagcgaaaactctagttaagcttacctaacagaaaaaataacccccaaaaaagcgttacgttccaaacatttagacagggtacacgtgaatgactcccactttttttaaaaaaataatagtactatcaattcaaatgtgtaaacaacaaaaaaaaaaaatgtgtaagtaacgtctgtaattgatttgataagataaaaaaatcttgattaatttttctataaattgaagcctttcctctttacatttcgtta

SEQ ID NO: 840 - DNA, 1000 bp, Arabidopsis thaliana
  misc_feature (1)..(1000): Ceres Promoter construct PT0569 as found in Promoter Report #158
gagtcaaaaaatgaattaaataaaacggtgtaatcttaaactgtctttagcacgttacgatgaaatttcaattttcgactaatctttgaccctaaacaataggtaaccaccgtcaccgtattaaatgctttttctattctaagaaatacagataagtttccacgtattgtattcgtcccacaaatattcataaggaggaaataatatcctttttttatagaagcaaatggaaataatgtgaacaaaaatccaagatctattacaaaataaaatattttaaaaatttaggaaagacaatcgatattattagcagtttagtccgaaaaatgccgaaatacactcaatcatagagatattacttttattattaccaattttgacacaaatcaattgttaaaacttcctaaaaagtaaaattctctaattgaatatataaataaaatatttcaaatgtgatttttatttacaaactttacaaatgttaataatatattcacctaaactgaaaacatctaaatgtcataaaatttgtatcttattcctaattctgatttttttttaatataaagttataaacacaattagtagataatctcattattcataattatggattattcggcgattttcactattgtttttcaccactaattatgccaccttgccagctgtattcacacacacacacacactctacacaagcaaaacttaaagtatgcatttttattaattatggttcatccattttattacagaagaataaatatttcatttgaatgagaataataaataaaaaggcaatgcttttatgatcctcttacctttaatcttcttcgtctctctatcttcctcgatctccgccgattccttcgtctttccctttcctctctgtaaaccttttcttcttcttcttcttcaatgcctccctaaaaccctagactcagaattctcaaaggcgacacctttaacctcctccactctgtttctttctccaacaaaa

SEQ ID NO: 841 - DNA, 996 bp, Arabidopsis thaliana
  misc_feature (1)..(996): Ceres Promoter construct PT0650 as found in Promoter Report #168
catacttaattctaaaaaaacaacacttatagtttataagcagctcttatgataaaaatctttctgagttatagctctgttaaacttgtattcaccccaaaaacggatgtttcatttcttattttttacttggagtattttattgtaatttgtaaaaaaaaatgtaaagtgggggatatcatgaaaaacaacgtcactttgtttggtcacaatatacatttgataaaataatggtcgtcgcgtgatttagttgatttttgttttatcaaccacgtgtttcacttgatgagtagtttatatagttaacatgattcggccacttcagatttgggtttgcccacatatgacataccgacatagaaggttaaatccacgtgggaaatgccaatattcaatgtttggttttcaaaagagaatcatttctttatatgatctcaaaagtatggaattgaaatgactaatgagcacatgcaattggtgctatcttaaaaaccgaacgtctttgaatttaatttgtttttcaccaaaggtacctaatgaaaccctttcattaaaaaataaaggtaacaaacaaaattttgtattggaaaaaacattttttggaatatataatttggtaatagaattatgagcaaaaaagaaaaagaaaagaaagaataatgagcataataaagcctttacagtattactaattgggccgagcagttttgggctcttgatcatgtctagtaatcttaaacagacgataaagttaactgcaatttagttggttcaggtgagctaccaaatccaaaaatacgcagattaggttcaccgtaccggaacaaaccggatttatcaaaatccttaagttatacgaaatcacgcttttccttcgatttctccgctcttctccactcttcttctctgttctatcgcagacatttttgtttgcatacataataataatacactcttgtcaggatttttgattctctctttggttttctcggaaaa

SEQ ID NO: 842 - DNA, 999 bp, Arabidopsis thaliana
  misc_feature (1)..(999): Ceres Promoter construct PT0659 as found in Promoter Report #172
tataataatcataaaacaagagttgatcaagtaacatatacataattttgatatagacaccatctaaaagcggccggaatatgtaatttagaaattttgttagtatttttagaatccaagatcgtacatatgtaaatcaaaaacatcacttctatggttcacataattataaattaataatttgtacggtttgaccgcatctattatatatataaaaaaatgtctaacatatcccaaatgagaagcatctcgagctatttataaaatactatacaaattttaaaaatcagtaagtacacttgttgttattaagaaaataatgatcctaagtaactcgtcgacatattcaattttggcaactactttcttgaagcaaacaaaattataagctagtatcaacaaacatatggatcatttaagcttcgataagcggtcaacatatgggggaattaggagacaaatcactacttaaaaagaaccactagtcattactttttgtggataacatgacaatcactacaataaaaactgggcccatcaagcccaagaatactcttaatgacaagtcaaaagagagatagttttgagttttgactcctcggacgaatcgcaagactggtcttgtccccctttcgagtttcccgggaaacttcctccttcctctaatctctctacagttctcaatttcttgcttcttctctcacgcttagcaattatacccaatcccatttgaatattactcttcgccaacatgtccttaaattatctctttttaatgaattgatcgataaagttctcacctttatgcctcctcctactttttccacttaatcatcccacttcctcttcagatgtaagcaatgttgtctagagtcctcctctgattcagatttcgttgctgaatcttttgtaaaactctgttctttgtatgtcgagaagccaaattcagggaatttagggttttacaaaaaaataaaaaagagtttctttttttggatg

SEQ ID NO: 843 - DNA, 1000 bp, Arabidopsis thaliana
  misc_feature (1)..(1000): Ceres Promoter construct PT0684 as found in Promoter Report #177
tagctagatttctatataaacagaagaaagttaaaaagcaaataaaaattcacaaatagaaatcgaacaaaaagctatgaaaatataaataccataaccttatggaaaaacgatgaaatgcttaacaaaaaaaactttggcaatggcatgcatgtgcctgtaacagaaggcccccataagctgttagtgatatacaacttaagcaaatgtgcactcttcacgcacttcccgcttttctaaatttcaatttatttgtctacatttttgtccaaattattgatataattctaccacgacttcccccacatgtccctccaaagagatccgtactacacagtctaccgacagcacatgcatggattttccaaaccatcttctttaaggataatccttgacatttttaatattaaaaaaataacaaaaaattcaatatataaataacatcctaaatctatgttttggtagaaaacaagttctaaagttcacatttggacagtggttagtacttggtaatcaaaatatttgtttaagaatcttgactacttacttagtctaaaccctaacgtacatggttagacatattagacacaattctattctatagcttcttaacaaacgtttagcataatccgaaattggttttaccaatatttattaccgtacgtgtgtttttttctgtaagaaaggaaaaaaagccaactcatgattcttctgatattgcatgtaatatatttgccaaataagcttacgacacaaacacaatgacactatgacagtaagatatcatttcaaaatacggatatacccccaaattggtggcaatgacaaagaaaaaaagagttcttcacagtggcacattcgtaatacatatgaactttggtggttgtttcgtaatatagatcgtacttaaaacctctaaacaccgttctctttatttgccatcttcttcattatcatcatctccatctctctctctctctctctcattttcttgaaaaag

SEQ ID NO: 844 - DNA, 1000 bp, Arabidopsis thaliana
  misc_feature (1)..(1000): Ceres Promoter construct PT0655 as found in Promoter Report #179
aaatcaatattaatactaaaatttaaactacatttaagtttgaatctctaaagcttgtgttaatggatagcttggaaagcttatctttccggagaacattattattgtacaatctattagctcttgattcttgaatttagttagtgcatctcctgattatgttccactttcattttcttctaattttaggaatctggatgcaaatccaggttaagtacatttagcttaatagaaagatgatttgactcggactgatgaaaatggtgccaagaccaaaactctaccactcggacgagtcaggtcaaaaacaactcaaattgactattgaaccatttttctaatctagaccagacaccaaaactctaccacagctctccgacattggtgggcctaataaattcccacaaatatttttttctgttttctttttctataaacggttggaattacatcttttgaacccatatttttttttgtactaaaatgattaaactcgagccaaaaaaatatcaatttattaggcaatcactacttgtataatgcaatttatggcgtgattagttccacaactgcatatagactatcgaatacttacacttttatgtttttaggaatgtgagtttggagtttgttaccgaaaaaccaatcaagttcaagcttaaagccttaaaccaatcaaaccatatcactttctatttttaggaatgtggatgcaaatcaacattaaatacatttagtttctaaaaccaatgttaccggttttgataattcccacaaataataagatgttcataaaaacgtggccaacaaccatttatgttcaccaacctaatcgcccctctctcaaaaaaaaaaaaatccaattttccaattttatttaacggtcacattttcctcattgcctaattaaaaacattcagacacaaatttagtttcttcttcttttggttctgtctgaatccaattttcttatattttatttcctccaccaccgtgagat

SEQ ID NO: 845 - DNA, 1000 bp, Arabidopsis thaliana
  misc_feature (1)..(1000): Ceres Promoter construct PT0656 as found in Promoter Report #180
caatatcacaataatctttctaagttatgaaaagaacgtctactactatttgtttaaaactacataggacaacatcaaatcagttttgaaattcattgtaaaattcttttaatactaaaattgtttacagttaatgagaaattacaatattatttttagcagattataattagaaaatacattattattattgatcaatttaccttgcagttccacgcaaaaccaacaaaataacaaataacaaagcattgtgtggaatgacgtaaggatgagtcagcagacaaggagtgagatcgaatcgggtcaagattatctggttgggacccgtcacatgcacatggaccctctcccgtacctaatccaggttaaataatcttgattttctgtttaattaccttaaaaacacattattattgaaactaataataaatctcggatctttggttccgaccatacttgcgaaagatcattgctttaatgctaatgtttctctaattttgatattccttgagattagattccctttgcattgtcttttcttgttaatttgttagggttcatattcttacattattttttttggcaaagaaaaaaacatttataaacatatctaattcgagcctgatctattaatgggtcaaataaaagcctctttggcccaattcaataaactggccaactggggatcatcatagagacagactactagagagtagagacgcatcagaaagaagagaaattgatcccacaagtttaaacacgattacaaattaaaacgtgccacgtattcaagacggtgaattaacacgacgtggcaaggtatgattggataacttacgcagctgcctaacaaaaacaagtgatttgagttttcagatgattagaaggaaaaaaaattctggaactttcgagcttctgttttgcggtgctctcaaagcttatatcggatctcgaatcttgaatcggactcagaacctcggatcttcgaaaatcgacgaac

SEQ ID NO: 846 - DNA, 1000 bp, Arabidopsis thaliana
  misc_feature (1)..(1000): Ceres Promoter construct PT0657 as found in Promoter Report #181
gtttatgcgtttgatttttggttctatacagatctctctatctcttttatgtaatttttgtattcatggatttcatacagttcaagttaagcaaacttactttgtaataaatgtaccattgttgttgagattatcaataatcgaatagctttcttctctaaattttagtcaactaaacaagtctgttcattgataaactcatttagataaatttgtggattttgaaattctggtaaccaaaagattatggtttgctacgcgctaatactggtgattgattacggcacaaaagagcccagtaaataattattggcccagtttagttttgggccttatgggccaatattatcatcgagcatccaacggtagtgatggagatttctttatggaatatctgatatccaccgttagattaagagacgaggttggctccgaatagcatatagttaaagggcaaaaccctgcgccgcccgcgtctctcctctctctgtttcttttctttttgtttcattttcttatctcctcacactcttcgaacaaggaagaaccctaatctcaaggtaaattcattatcactgtaattttcctttctattagtgttttatctctccggttctagggtttctctaatccccgattttgcaaaatgtcagatatctttctttcttgattcatttcgcttctttctgtagataggattagtttttgtcggtgtttgggaatttactgggttttcaacttctctgtgtgtttgattgggggatttggtatacctaatcgattgaaaatgattaaatttaggttaaaactactagtcacatcaccgtgtcttcatacgcatctgagtttaaatctgttcgcgcttactttcttctcactagtttcttgtataataagaagtttttgtgaatgtattattagcagttaatgtgttcattgattcttttggaagtgatttggggattgatggattttgcttcttattatggtttatacacag

SEQ ID NO: 847 - DNA, 1000 bp, Arabidopsis thaliana
  misc_feature (1)..(1000): Ceres Promoter construct PT0660 as found in Promoter Report #186
caagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagttaataaaagaaaccacacgagtgacctaccgattcgactcaacgagtctaccgagctaacacagattcaactcgctcgagcttcgttttatgacaagttggttttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctctttgtccttttattctccgtcgtcgtttcatgatctgactctctggtcttctcttcttcttcttcttcttctattttttcttacttcgtcactgttgtgtctgaac

SEQ ID NO: 848 - DNA, 1000 bp, Arabidopsis thaliana
  misc_feature (1)..(1000): Ceres Promoter construct PT0679 as found in Promoter Report #203
taagaaaaactgtaggcttgttgtcagaacaaacatggacccatgttctctatgtccctaagatgtgtaccaatctcaattcacttcttttgttgcactattttttaaaaaataacttttattttatattttgagatctccattgcccctgctgcactagacattacagctcattttttccttataattcaatccctagctatttttctttcttattagtttaaactaatcatatttgggtaattagcgttgaaactatctatcatatcaattttaatgatacatatgcaatactttatgtgagtatatgcatgtatgcatgttccaacatccagattaatgactaacgtttaagccctgattttttcagagaaattttgtgttgtacctatgtttgtattacacacaatatttaccattgtttaacatgtacacatgtgtttataaatctccgtacactataatgcatatttgaaccatatatgacagaaagttttccactagttctaattacattttgttgccctttcctactcgtctattgcctatagaaatattattttagttatgattaagaattgggatgcacattccgaaattaattattaaatgccactatgaagaacccttgaacatagtctaattcaattttaagatcataaggaacattaacagtgacaatagctaaggtctctcgacaatgagacaatccgctttttaaatatatacatataagagataccatattgtatacatatgcagatacaattacaacttgaccaaatttattcaatttctccttctctttatatcaataagaaactattcatgatactggaccagcctgtttgaatcttgtcccatccacaaatctcccaatatataaataaagaaccttcacccgtaaaaccaaaaccatcaacaacttcaaagctttctaagcaagagattgagagaaatcggattttctttctaagactcaaaatatctaaaaacaata

SEQ ID NO: 849 - DNA, 1000 bp, Arabidopsis thaliana
  misc_feature (1)..(1000): Ceres Promoter construct PT0678 as found in Promoter Report #178
  misc_feature (14)..(14): n is a, c, g, or t
  misc_feature (235)..(235): n is a, c, g, or t
aattaaatgaaacncgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaancaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 850 - DNA, 1000 bp, Arabidopsis thaliana; identical to SEQ ID NO: 813
  misc_feature (1)..(1000): Ceres Promoter construct PT0623 as found in Promoter Report #161

SEQ ID NO: 851 - DNA, 1000 bp, Arabidopsis thaliana; identical to SEQ ID NO: 814
  misc_feature (1)..(1000): Ceres Promoter construct PT0613 as found in Promoter Report #163

SEQ ID NO: 852 - DNA, 669 bp, Arabidopsis thaliana
  misc_feature (1)..(669): Ceres Promoter construct PT0848 as found in Promoter Report #190
tctctttaaatcagttaactaaccgtttatatatttacgataaggtttgaagagattattgataaaataatacatttcataatcccgcgttcaaccgtttaaagtaacatttaagttgactatatctaattttttttccattaaatatggagctggtaaactttatcaacttctaaaaagtgtaacaacaaaaattaggtcaatcacaattctgttttttttattattttggattgacttccaattgcaaatagtcttagtgatcaccattatcatacatatatacatcaagtaggtttcatcatgatataccacaaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

SEQ ID NO: 853 - DNA, 623 bp, Arabidopsis thaliana
  misc_feature (1)..(623): Ceres Promoter construct PT0852 as found in Promoter Report #192
aatttatcttatgttcatgtgtcaaagtggtagtgaatctagtgacgttattgattaatcaagattacttttatctttctgtgcaaaatttcaagattactctaaagtcgatatatgctactatgacgtagttttgggacaattacgtatagagtcataaaaacaataagcagaataataatccatttaagtacattgtgaatttgtgataatggaattatttgacaatacttttccaaaataaaaactaatttaattactgtattaattattttagtaaaacaatattttcattacaatgtttgttgtgaatccaaaaaagtattgtttccaaagaactcaaatgacatcaatatgtctataataacctcgtgtagctgtatgttagaatctagccgaattgttttattgttgtcggtgtacgcaacaaacgaaccacacatactttgaaacgtggcacaatataagtgggtcaccaatgtagctgacaactataccatctatctgatccgatcgctcttataacataagcgtatgggataccattttctcggacaaagctgaaatccctaaagaaaaaacacttctccaaacttttcatctccgatatctctttaactaac

SEQ ID NO: 854 - DNA, 615 bp, Arabidopsis thaliana
  misc_feature (1)..(615): Ceres Promoter construct PT0857 as found in Promoter Report #200
agacacaacgtgttctgttcttgtggtttttgttgttttgatcatcttgaaagacccttttttatgacaataatcagacaacaaaaactctttcaacaactacataaccactctcactatcttgcttaattctaacagagtttgaaatgtgagaaacgtggtttggtttttttttttgttggagaaaaaggaaatcatttctgtatttcctgattcataattaataattttaaggtcttatcatacaaaagtgactcaatgattggtcgagagtgtattaaattttaataaaatttatttaaagttcttgaatctttgtctatttatacttttcttatgcttgtggagtggtttactgctactgaagataaggcaagatatgggcgattgctttttagttgtttattacattcaccaacctgatattggcaaacgacactaggagatgaactgtcagaatctgatatgaaatttttgccaccaaaaaagatcactaccaacatataataattgatatggatttgcttatatatataggttacggttgttatctaaactgcattataacactcaaacacaagtcaaagtacctcctgcttccacttgttctctgcc

SEQ ID NO: 855 - DNA, 1000 bp, Arabidopsis thaliana
  misc_feature (1)..(1000): Ceres Promoter construct PT0757 as found in Promoter Report #255
aaagattatctattaggtatttacttcttctaatatgttttttttttttaatatataaatggaagctatacatgaaatgacaaaaattcatgacatgtagagtgtaactattaatgtctattgacgtaacaatagtggattgaaaaacaaattacttttgttttagcttgatgtatactacactaatcagctgaaagaaagaaaaaaaaatccctccaattgagatagtaagagtaaaaacttattttacttaatacaagctgaaaattttaccctagatcctcctaacttttctttattctctttccaacataactattctaaaatttagtcaatcacacacatctctactttactgattagatagtatccgactttagtttctgatttctctattaatatcgttagtcattatctccaattctctcaatcattagtcccttttcaacacacaccgctcgtattttgcatcagttacacgttgaaagtattaaatattgtaatattttaataaatagtcatcgtggggatgtagctcaaatggtagagcgctcgcttagcatgcgagaggtacggggatcgataccccgcatctccacttagttactattttaaaacagttttgttatttagtgaaaaagtcaactattgaaagataggtgaaaactccgtgagtctcaagcaagacccacaagttacctgagcttttttcttttcttttcccggcagctacttggatgaaaagaaacagctgccgtttcaaattcactcattttccgacagtgaacagagccatatagacttgagcgaagaatctttttgccttttctcatctattggctaatcagaaaaatttaattccattgacttttattcgattacctcattttctattataatatacacagaggtaccaaatttcaacagtagtaggcagatacctattgtcttagaaaacgttttctctttgttctgttttttgacacaaaggaagaagaag

SEQ ID NO: 856 - DNA, 1000 bp, Arabidopsis thaliana
  misc_feature (1)..(1000): Ceres Promoter construct PT0764 as found in Promoter Report #256
aacataaattttttataatgaaatttctaattcgagaaaaaaaaatttagtcacttccgatccacaaaatctgagttaagaaattgaaaaagaagagctaaatgttttatgtttatggaacattattttaaatgttattttaggtagtcaaatgggttatctttgggccagacattagtcattgaggaggcccacaaaggtatagaactagagtaacgaagccttgccttgaaggcaataatcgcttctcccacatcggaagtttgaggatggatactcgtctgtgacatagtataaataaagaacatggtcgaagcttgcaaattacttacctggacggggtcaactcgtgatcaagaagacgagtggcctaggctagtgaattccattgcacataacggaagggtgcttagcttaaggtcttcccttgtggaagagcctgcgtcattatttgtggcagagggggtttgcgttcgcgcagcccctaccattcccagtagttcaatcttttgttcatgaatacccatggcctaggctagtggcttcctgcacttgaggtgcgctaagcctaaggtttccccaaatggccaagtgggagatcctgcgtcattatttgttgccttggggggctgcgttcgcgcggcccattccatccgcaatagttcaatctttttagctctctggtaactgttataacatctgaggtctttctttaattgttcacgcttttggtggagctattttattgaaggttgttaatttgactttggagatgcaatcttctaatcaaatctccacgtgagaagcgaggattctctcctcgtcattatttatccttcccaattagagtaatcacacttttctgtcacatatgaattattaaaatcagaacttaagcgaaatccttcgaccactaaagaagaaaatccctaacaaatctcagagtttgtgttaatttcttctttccttacatcttttccagaagaaaaaaagctgaaag

SEQ ID NO: 857 - DNA, 1000 bp, Arabidopsis thaliana
  misc_feature (1)..(1000): Ceres Promoter construct PT0767 as found in Promoter Report #257
ttaaacccgggaatctggtaaaatgtttggattttggaacataagtacaatgggatgatgtgacttctgctagaaaccaaaaagatttccaataaacaatttacatgatgaacctaaaagaagaagaagaagcaaacatcattttacttaccgtgtctaaatttataaatttctttgtattatcaatgtgtattgtcgatcacgacacaatcatattgtttatcttcatttttttgttaatcatatagagggcacccttaatcatatttggttattgtttatgcagttctttaattctcgagtaaccaataagacagaaaattatcttacacgtgggcttctaccaagattaatgtctctcatcatcgtccttgtccacattaaaacaaatccaaatacacatatctttagaaacataataagtaacaaaattatcacagccaataatatcggaaacttttgttttattctaaactttgtctccctattcgttctttcataaatttatgttctaatcaccactgatgacgatgatgaacccattatcttttttttcttttttaatatgaacccattaactttctagagccaatcaaaatagctgtacaaaagaaaagggtgtcataaaataacttgtttgcttcatccatcttatatttgagtacaagaaattagtaggatatttaatcttggcaaaacctttgctaagaaaatattgagtacaagttttaagtggtggtccatccaagaagctcatttgaactattaatataccttgttcatataatatgtaatttattaacgtatatgtaagtaaaattttaaaaagaaaacaaaacggtccaaagttgtaccctctttaccaatcagaaacctaacactaaactctctctgtctctctctcttacatatataaaaacaaacctctccaactctgaactcaactcatatctctaatcactaaaacataccacaaagaagaaacataaaaaaaaaaagt

SEQ ID NO: 858 - DNA, 1000 bp, Arabidopsis thaliana
  misc_feature (1)..(1000): Ceres Promoter construct PT0776 as found in Promoter Report #259
ggcacaacgtgggaagattctctcacgaccatcatctttcatgtgtgtttttttaatgacgccattcgaaacaaaacattctcccgactaatgaagacatgcggaaactcaacctagctcgaccgccaaggatgatataactaaccttataaccaataaaaactttgcgttctttagttactcatatttaagtgaagtttaatcatttgtaaaaaaacattgtttgtgtcaaatcattggtgaggtagaactaaaatggtagttttcttaaaagactttgatcttgcctaattagccatcatctttgaatagaaaatagttatattggacagtaagtgagacacattctctgcccatgtttcactgtcccacaaatctctaatgaggacaaagctttacaagtcactcagtgttttatgatttagctagctgttcagaaacccacgatttcttcatattatatatcccattatcattattttaatcttctttctcaccgcttagttgtttgatattgcacagatcagcaagataatccttcaggatatggttatggaattagtgctcctcaaaattttcggttcgactttattcacaatttagcatttgggtatgcatatgaaacaaacttataatctaatttcgttttctcaaacacaattcacaatttaacacacgaagatagatgaaaacatcaaggaaattgtatcactttttctactatgtaatgtcacagatgcagaaacaaagcgaactacttgctatcatacaaattgttatgacgccaatggaactcgcatattattccaccgaacgaaaaagaaacacaatcatgataaaataattgagagagattaaataaaattagattctgactaatcattgtttttcagcttttggtttccactctcttattatcaacttcgcttggggaccttcaatctcagttgcacaaaaatgccataaaactagccaaaaagtgaagaaatagaggagaaaa

SEQ ID NO: 859 - DNA, 362 bp, Arabidopsis thaliana
  misc_feature (1)..(362): Ceres Promoter construct PT0889 as found in Promoter Report #260
cggttgacacgtgaatacgtaagtttgtaactaaccgtagcatatgatatcttttcaatggtggcgcgtggggagcacaagttattgatttgcctcgtcggcgtccaccaccattatcgccggatttttatatattcacgtagaagaagaatgagaagacgaaaaccaacttctacttcttctcagtggctctctctttatctttcttggagtttagttagagattttaacgttgcaaatggatcaaccaatgaaaccaaaaacttgctctgaatctgattttgctgatgattcctctgcttcttcttcttcttcttcgggacaaaatctcaggttttagtgcttaaagatgttaactttac

SEQ ID NO: 860 - DNA, 1000 bp, Arabidopsis thaliana
  misc_feature (1)..(1000): Ceres Promoter construct PT0585 as found in Promoter Report #267
tgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttata

SEQ ID NO: 861 - DNA, 1000 bp, Arabidopsis thaliana
  misc_feature (1)..(1000): Ceres Promoter construct PT0565 as found in Promoter Report #268
caccaaatatagtgttatttcaatactaaaatggtgttatggttggagatgccctaaagataaacatgacgagacacgagatttattaatttcttgatcaaccataacttaataacttaatattaatttcacttaataatttccaattaagtgaatctttacttcaccaaaagttcctaacgaactcttattttctagcatcaatattaccatgaactagcatcaatactatcatgaaaaattcctacttcctatccaactcttaataacaatgctagtcttaacaatattcatcaaaaacttgatatagaccttctaacttagccacgactagtatcggtgaataccaaaattaatgtattcatgagaacttgagatttctctaatgtattcttgttactaaacaagtaacaacactcaagaaatatcatgatcaaatattttactcataaactccatatttcacattttgaaaattttaaacagcaaatcacattgaattttcgtggtaaaagtatttaaaattgaaaaatagcagctcctgatttcaatgtataaatttatctttatatggtttatgtctccaacttattttaaaaaagagagaaagagcacccaaaaggtgaccgtttgaaattcgaatttatttccgtttgaaattcgaattcaaaaaaagtaaaccgaaccgagtctcgttactgactgtcacacattgtttccctaaaagctaattaacccatacgtggcgtaatataacaggtcagtgatcaatactaaataacagacatacacctttaaaattcgtgcacgctccaaaacaaaatctacacttcaaaatcaacggtcacgatcattcctcaaatttcaaaaaattatttaacctcacttccttcgctttgtttttaaaacctctctctctttctctttctctttcgccattaaaactctgtttcctttttcagagattctcagagaagattcattttaccctaagaaaaaa

SEQ ID NO: 862 - DNA, 1097 bp, Arabidopsis thaliana
  misc_feature (1)..(1097): Construct PT0505 from Report Number 134
agtcgattggcccgatcggccagtctacgaaccggcttgcgcagtccacttaccataacaggcagtattagagtgggatatttgtaaattgaggaagtcactgcctcactggtgacagtactttgtagatacctttctttaattggttctgatgtgtttggaattgtttgtttggaaggatttgataacaaataaaatacaagcaaaaaaaaaaaagatatggtcagaactcagaaggcaacacaacgaataggttgccgagtggggctcatgccgttgattcttctgctcactgccccttctcctgtctattcacttcctttgtcccttatttttatctttatttttggtggtgaaaatttatgtttcatttatacaagctaaaatgtttttgttataagtcaaacaaaaacaattattattaataatattggaggcttttattgtacttttggtttgaaattttcgaaactacgtctcttaattctcatcctttgatattctgtgcaaatgaatatttattttccatatagatagatattattttttttgttggataacatttacactttacccaaacttgtaaacatgatttcaccaaaaaaaagcttgtaaacttgaatggaaaaaaatcagagtatataaaagatagtcttaaaattggacaatgaagtaaatgtggccctcaatatccggcatttgcaagcaaatcataccatctacatgtatatatactaaaatgaaatgctttattaggaaggaaatctttgaacagaaaaatagaaataaggtaagacaagaaaaaataacaatgaattacaatccacaaatcccaagaatgagaaaatttttaatttcctaaagaatattttgacacgaattcgacatgtataagataaaactattaattatttcagacgcctatatataaccaccataactcttactctgttaccaccacaaagacaaaacaaaaaaaaagaggaagcaattactataggggaaaaaaaaatctgaacaaggcctgcagggccagtgcactgggatccaacaatgtcctccgactcgtccaagatcaagaggaagcggaaccgcat

SEQ ID NO: 863 - DNA, 1000 bp, Arabidopsis thaliana
  misc_feature (1)..(1000): Construct PT0561 from Report Number 159
cgggctatactggacttttgcaaaaatgtggtttttatattttatattgtattaggtttctgttaaaattaaatgagaattttaattaaaaagagaaattatttgttaaaaaaaatcaggatggggtcctaattattatatgttttgattttctatgagaaagttgcaccgtccattgtttcttgaaaactattatctgactaaaagaacagaaaatgtaaagaaaagacaaagagacacagagacgactctgttaaataactctatagcagagtctctcgagttaaatcaataaaataaagacctgaaaacatatatttcttcgaagcagtgtctaaaaccaatgtacaatttatgacaaaaggaacatgttattttagtcgcatataattacaaaataatcgcatgatttatctaagttggtctttattaactcttaacaaaaaattaatataagaaaacagagtcagaatttaaaaaccacttaattagtccttcaagaacaattatcaaaaccttaataatgttttcatccaataacatcctcgaagtctcctctaaatcattggatccaacgaaattcatgtttatctaaactaactcgaataaagaaacgattataataattgcacactatgaaaaatatcagaagcgtcatagaaattgtcggctacctccatgcacggaaccttcacgaaacagttggtccctcacacacttcatcgccacgctataccacgtgtcaattttacatacaccaaaacatatctactaatcatacctcttcacgtgtaacaaagtcccattcaacgtggcaattacagaccccaaaattatgaactaatcaaacctcttcacgtgtcgcaaacttgtagaacgttgaaaccccccactcacacgaagtgtatatatcctcttcacaacacaaacataaacattacttcaaacaaagacttgaaagaactatctttgttttcactcatatcttatctttattaaa

SEQ ID NO: 864 - DNA, 1000 bp, Arabidopsis thaliana
  misc_feature (1)..(1000): Construct PT0688 from Report 183
acgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 865 - DNA, 734 bp, Arabidopsis thaliana
  misc_feature (1)..(734): Construct PT0839 from Report Number 239
aactcctagcctaaaactaaaacacagttgatgactaattggtggagaaccattaaaaaaaaaaaaaaaagacagagtagactaacgaaaccacacctttacatttttctatttatctcaccttcctaaataaaaaatatttattttaaacaaaaacacattttctgtacagacgtgggtttcgtaatgtccataagtccatccgtagtctaccatataatttaacatctacttctctccagtggacgcaaaagcttcgaattgaatgtgggcgttgcttctctcgtgtctaatataaaatttggataatcatgaattcttcgatgatagtgatataccgttgacactgagtagttcattgcaataagtaagatcttgtttttgctaaaaagattcaatcatattttgaacacttgccacccaccacttccaaaacttccacaaattcatagatatagtaatacacaggttacttgacaaaaggaataaaagtacaatatgatgctttacacattctcagtcaaaaaaaacgataaaatgaatgtgtaagataatattgtttaaaaaagaaaaaaagaacaaaaaaaagataatattgttttcccgacgactaatccacattcagtattttataaaataactgaactcaagttgctcgatcaaacaagtacccttaaatgtctctctgtctatataaatgtacactcttcccaaacaaaaccatatctcaaaat

SEQ ID NO: 866 - DNA, 1000 bp, Arabidopsis thaliana
  misc_feature (1)..(1000): Construct PT0758 from Report Number 243
agctagccacatcagtgaccaaaaaagataattaacaaaccaaataaaataacaaattttgatcatttggaataaaatttataaaaggaacgaaagcgccttctcacgggtcccatccattgaaatatattctctctttttgctctatataataataacgcgtactaatttgtagtatatattattacaaagtcgatatttgattgttttgtgaacgttgatatattaattttcttggatgatgacaaaaaaagtcatagaaagtaacgtgtgaacatagcattaacaaaatacaaacataatatataaccaaatatatgaaaataggataaaatctcattgaatagatcttcttctattcaaatatataaatatttgtttgtctataaaattaacagagcattcacattatctaaaataatagtaaaatcaaaataaaactaaataaaaataactctggttttataacgattgattttaaatattagtttttgttgtaaagagatcattatatatgtctgtaatatttttatactgagttacatgatatttagttattatagcgtaattaactaagataagaaattaactaaagtgatattctgattattattatttttgttaggacacgtacgtggaaaaactaaacactataggttacaaaacggtataataaactcaccattactggaaaatgtttgcatttgactcaataagtaacttattataagttactgatataatgcatagttttgaaattcttaaataaattattttggtttcgcatgaaaatatgaaaggagagaaatttattattgtcacttatatatatatacatcgtaatcattttttcgtgaataattctctctcccattccattatttctcagtatctctctttctttcccttactttattgttgcttttaaaccttcaatttgctcataaaccaaatatataatatcaaaacaaacaaacaaaaaatcagaattcccctaata

SEQ ID NO: 867 - DNA, 360 bp, Arabidopsis thaliana
  misc_feature (1)..(360): Construct PT0888 from Report Number 244
tgactttgtaaggacaattaccaaaagagatttaaaaaggacacaacaacgaagatttggtcaactttaggttcataatcataatgccaccaacaaaaattctttcacatttttgtgaaattgtgaaagccaatataaacatttcctgttttaaatttttttatgaaataaaactcataatgttaacgaaatgaattattaaatgattgagaccataaatggaccgcacgtatagtagtgcccttccacacatgtaacgtaatcttctcctcaaccaaaaagtctaaattcatattatatatacacgaagactttcttacatcaaagaagcacaatctgaaaatcatcgaatccaaaata

SEQ ID NO: 868 - DNA, 1000 bp, Arabidopsis thaliana
  misc_feature (1)..(1000): Construct PT0803 from Report Number 248
taatctaagtttgcattcgatatttgcaggatttgcttcaacactataacatggcctgcaagttttgatagattccaagaaatttgtttcatttcatcgctgtattttgcagtttgtcctagaagttggagatatcgagaaaaaacacaaacccttgctttcttctaagggctagtttgttctgtttacctaatacaattgtcatattcaattgatgattccgttacctttaacactttgcctggaaataaactactcattatgcttcatggtttccattacctctctgccagtgaatctgacttaaagctatttaatctcgttcattaatgttcatgattgaaattgaatcactattggtgaattatgtttagaaattgaatcagacccttgttttcttctaacatctaaggcctactttgttctttttgtttatacatttatcatcttaaattggtaatctcgttactttagcacttctggcctacaaataaactactcattatgctgaaattgtttgagttcccttaccaaaaccaattaagatactgtttatagtaaagaaaaagtgattgaaacagttctgactttcttgtaattttgtagtcggaatcatgcgatgtttattggttccaccaactatgcactgtcaagtgtcaaccaccaaatacactatactagagacttaaccattagaaattggttcttcaaattggccatataaattataaatccatgaactgactaaaaagactcatcgttgctttttgtgaagtgttaaaccaaatgatcacggatataaattagaataattgcgacacagatctaccagcaatttcgaccgttgcaacaaagccatgattcaaaaagtttgcttttttaatcttaccgttggctcctagcaactgcaaatccttaagatcaacatctccttcttaattcttacccagttattgaattttctgaaactatcgttcttgatcttaaaagctcaacaaaa

SEQ ID NO: 869 - DNA, 999 bp, Arabidopsis thaliana
  misc_feature (1)..(999): Construct PT0779 from Report Number 249
tcaattttggattttgttatttgctattcaaaatcattaaagataatttggtcttaataatcttctaaactttatatgatctgattgaatctaaaccgttcaataaaattaattcccttcaatctaaaccgttcaacaaaaataagtgaaataattttatttttttatcttcactttaaagacatataattataaataacataattcatatggtctttattttgccaaaaaagtgtataacctgtcaaatagttaaaaaaaacacttataatcataaaaaatattataccaattttgtgaatcttacatttttgtaaatattttactttcactaaaattacatacacatttttaaacacattttaacacatttatcttatcactaaataacaacaaaaaaaaatcccaattattatttaattatgtttgattaaaaaatttatatttataaatttaaaatatcaaatttattcaaatatttagtataaaaacccaaataaaccgattgtccgcggtttaccgcggattaaatcctagttattattattgcgattccctttccccatgctctgaaatttgttaatcatttgtccctatttctgcttaaccacttacatttcataatttttgagtttatattgtttaatgtatatattttacactattactttcattacttaatagtcagaaatctcataccataatcattacgatacaaaatcatagtccaattattttcttcattactgactttttcggctcttttacaaaaagctaatatctttatctacagttgatcatattttaattttcaccaaaagtataattaaacagaagactctaatcatatcagtgatcaaagtgggccaacatgggcccatacacgccacaaagaacccaacccaaaagtccaaagatattctttaagctcagtttataaattgcattctctttctccttcctacaggccaacccaacatcaacgacttattcgagaga

SEQ ID NO: 870 - DNA, 763 bp, Arabidopsis thaliana
  misc_feature (1)..(763): Construct PT0837 from Report Number 250
aactacaagggagacataatatcaccatctggttcctgttatcatctgaagatttcttgttttaccttccagtgataaaatgatccttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgatt

SEQ ID NO: 871 - DNA, 1000 bp, Arabidopsis thaliana
  misc_feature (1)..(1000): Construct PT0818 from Report Number 251
aatgatgtattaactctgtaaattaagataacgttctttgtattttatatgtcattttaagaaagtattttatatatgatttgtattcattttaagaagtatacgaagagagtttgattttattttcctcgtgacgaaatttgtttctgataaatttgaaagatatgatttattttctgtcttggtaaggtcagttatcacattaaagactaaatagtaaattttatgtttttttgtttctgaattatttcagaatttcttgttttattcatttaatatttaataatatatgttaaatgatactattacactttagaaaaatgtgcttatttctatcgtaccaaacttctctttttttaccgaacttgttactgtttgttttgtgaacgatttttgtttataaaaacattactcgtttgtgataaatttaacacatttttgcataaaaatgtatcaatcatatacaaatgaaacattacatttttagtcatttttagtcaataagtagacgtgtgtatcatgattagttgatttaatcataattatgatatttaaaataaacatagtttaatgttattatgttggtttttaatatttttaattaacgtcaacctatttttttttatttttttttacatataactatgttgttatggaagtcactattaatttaactgataaaatatacaataaaatagaaaaaacaatagattttaataaaagaataaaaaatttgaagatacaaaaacagttcctttttcttaataaatcaaaatcaaagagatagtgtactgaagtgaagagccagccactatacgacatacgtatgtaattacgttttaataacctgatggcaaataataatatattttcgtcaaaataaaatggtcgtatctctttgctaaaaccaaaatgtcatgatgtgattactcaattttctactataaatagattaccaaatcattcgatcggagacaatcaccaaagaaagaagtacaaa

SEQ ID NO: 872 - DNA, 1000 bp, Arabidopsis thaliana
  misc_feature (1)..(1000): Ceres PROMOTER PT0695 As Stated in Report Number 211
aacattttctttaacttactcttaaattttaatagtaagttgatgcatgttatgttgatccgtcttgatcacaaatattgttttatggacgaattctttgacagtaaatggctatagtgactcagcttggagcatcccgatatgaaaacaaagtgcagtattgtgtcgtggtcatcactaacgcactttcctagaactatcgcgcgtgtttgacctatgcaacacaccagatgtcatgaacgtatacttaaatagaaacaatgatatagacaattggctatattctgtcatggaacgcaaaccggataacatgtctattagattcatcggacttgatcatggttatgtcttaatagacgaattctttgttaacgattggttaaaacggctcacgttagagcatcctactatgacttcaaaattgataaatattacatggaaatcactttaattttagttagaaggtagttaatttagatattcttatttaataaattaaaaaatagaagaaaaaaagatgagaagagtttttgtttataaaataagaaatatcttttattgtaattttaaaattaaacaaatttaatttatattaaaattatctttgttttattgttaaggcaataattatttttttggtgggaattgttaaaacaataattagtatactgttaagtggtcctttaataataagataacgtgatttaaaaaagaacgagacaggctaatatagtagagaggaaaaaatacaatttaggcccaataaagcccaatatagagttgtgctcaaacacaggtcttcgccagatttcctatgacgccgtgtgtcaatcatgacgccaagtgtcattcaagaccgtcacgtggcgttgtttctacacataggcgatccatacaaatcagtaacaaacacgaaaagagcattcatatgtacgaaagtagaaaagaagagactctttgtgataaaactaagtaagaaatagcataaaagtaaaaggga

SEQ ID NO: 873 - DNA, 435 bp, Arabidopsis thaliana
  misc_feature (1)..(435): Ceres PROMOTER PT0879 As Stated in Report Number 225
ttctaggaagactggtcaagctaagctgtttctgttttttgtttttgtactttactttttgtttgctagtgggaactgggtttattgggccttgaagttgataaaagatgaataaaagacatatcgcctaaagcccatatgagaagcagaagacaaaaacctccaactttgggcataaattttgattatagttaaaagtccagacccaatttggcacctggcttagttacgattctaaggcatgacacctgcctaatatgtttattacagaaaataaagagaatcagctaggtgtcccttattgaacacattaacaaactccaacgacactacgtgtcttcgtgactcttactatatccaaaaacctatagctaaagctgaattttccatgattagtatagtcccaaccaaaaaaatactgaagaaggcataagc

SEQ ID NO: 874 - DNA, 1000 bp, Arabidopsis thaliana
  misc_feature (1)..(1000): Ceres PROMOTER PT0738 As Stated in Report Number 246
ctcataatctgaatttttcaattgcatgtattagctagagaacaaaaaatcggtactgatttgaaggcctaaaaagtctatgttgtttagaacgttcaaatatcttaccatgggaatgaaagtggacacgagtcatgtgatcatccttttggcaccattgttttgtcttctaatcgaacacgtagtgtcattttcatatcttcaatcgtatattttgttactactagtcaagtttcttcttatataagaaaatgggacatgatggattatgatttaagtgttccaacggtaggtaatgaagttaattcgactttttttaatcattttaataatgagatgtttggtgcgtcatacataaaacacaacatcaggtctcatcattaggcccttttttagtaatattcaatgttttcttttacattttcatatcacggatccaagtaattaagaaaacaaaaaacaaaaaacgaacctaatttatatacacatttcaacatattaatagttggtagtagtaggagataaattgatatctagttaaataatcttataagttttgagataattggtcggcgttacgactgtattatatacttctttttacccggttagtattttcctaatgagaaaaaataaataaatcgattcatgaaataaaataattttgaaggatgatgacatgatgtaatagagttaagagtagataccatgaaacaagggtattttattttcaaactttctaaaccataaagcacaacacaacagtattggtgtcctaactttatctgtcttctaataaatattaaatagaagaaataaaatcgaaacatgttgaccataaaaaaggttttgtttgttaaacaacccggtttcaaatctaacacatgaggttgcttctcatacgttcttaactagtagcagcagagttatctatataaactcttctttgtcatagaacaataaaaaccaaaaatcaattttcagaaaccatttcgtgaca

SEQ ID NO: 875 - DNA, 960 bp, Arabidopsis thaliana
  misc_feature (1)..(960): Ceres PROMOTER PT0834 As Stated in Report Number 247
attggttcaacaaccctcgggggattagggtttaggtaagtataagaaccctaactttgtaagtatagcaagtactgaatgatgtttgattgttaggtttgtaatttttgtgtcacaatgttaaaaggtatttcacagtggtaaggtgctttatttgcgatttgatttggcataggaccttataagttctgacactgtagagaacctatggaaccttttcttatgtgatactataagaaactcgtgattttagctgcatctgattgacgttttatgttttgataatagtttttggagacatgttgtcaaagtagaagtaaagacaaatgtttctttaattcgtcggactagaaatcaaatcttcaaaagccatttttgtcgtcccaatcgactttcaaaaaagctttaaattagaacgacacaacaatgaatgatttaacccacaaaaagcttgaatccaaaaggtttgacttttcagaatttagtcttaaaattccgtaatcctatatattaacggataagatccaacagagcttcagaatttgtccttaactcatattcttcttattttctatattataattcgagggttacgtgtcatatgcctactactgacatcacttgcgtcttccttttctcttgtcctctttcgtaatcattaaagtaagtaccttttaaaaaaaataaagaaaccaacggtgggagaggaagcagagagagagaaaataaaaaaaacagaaaacgagaaaaccagagattcatcaattcattgattctttagttcttcttcgtccgtctaaccttagaaacttatagctacagcgagagaagacgaagaagaataagaataagaagaaagaaaattgaggcctgcagggccagtgcactgggatccaacaatgtcctccgactcgtccaagatcaagaggaagcgaaccgctccgcacaaaaagtcacaca

SEQ ID NO: 876 - DNA, 1001 bp, Arabidopsis thaliana
  misc_feature (1)..(1001): Ceres PROMOTER PT0746 As Stated in Report Number 254
aaagatcttgatggaaattaccgaggcatatattttatctatatataacaaattaaaatatcaaatatatatacaaaagctcttggtcgtttttttttcttcttttttggtacaacattcagaagctacaaactcaaatacggagttggcgtatacatggaccaaggatccaatagaaacatgtatagtattaattgagaaatacaatgtgaatagcaataattatttttaaataaattactgaaattgacagtgaaaaaaaaaagaaactactgaaacagcaaattgaataccctcatcaaagggtgaaattgttagaaacataattgaagaatcgtggaagagatcacatggttatgatttgatctttaatacaacttggtgttaatgattttgattttcaatatagaaaagattattgtcgcttattgaaccacaattaacaaattacgttactaattgtattttacatatactctaaaatcatcaaatagaagatgtagttagttaaaattgtcaaatagaagatgtagttagttactaaattctaatctggacaaaaataaagatgtggttcatacgtgtgagaagagacactaccattcttttattacatttcgttgtagtgaggctttttctgttcagtcttaaaatacaaattaaactgtccagtgtccactacactaatcacttcatgctacggcccgctaattaatgtttaaatatgtattgatcggatcagaaagaatatttgtatgatcaaaaaaaaatctgttctcttcctcacagcttttctctcagatctgtttgttcgggtttatttttgctctcttgcttagttctgtttttcactcaactacaattctttcttaagtttctatggttagatgaacttagactgttattgtttttggaaaaatccgtagatctatccgtctcaatactttgataaactaaaatctgtttctttttcttataaaattgcagattttgtatcacac

SEQ ID NO: 877 - DNA, 1000 bp, Arabidopsis thaliana
  misc_feature (1)..(1000): Ceres PROMOTER PT0607 As Stated in Report Number 299
  misc_feature (305)..(305): n is a, c, t, g, unknown, or other
agttaatgatgaaaattcaataattaagttaatttgttttttgattaaaagaaacaaaaagcatcgtttaagaaaataacaagaaaacaaatcatacgtgattttacaaatttatgctcttgtcccgtctcattaccaagcgggaaattaaatcttggtctagatggaaatgcgtttcataataaaacaagaatttgaaatcggtaatgaaacaagatgggacgaaaactgagataggatatggaatggaaatctggtccacacatttatcggaaggtggactttagctttcaggaattaaagangttggatagattttccgtgagtacaccaaatttgtagtattaacagaagttgaaattacggtgtgaactctagtagctacaactcccaagtctttaactacatttgatatataatgttttggaacattcgttctctactactgatcaccacgtttacatcacttttctttacttggtctaggtaatttaatttagtactcaaaggtatatatatgttgtactgtcttcgtctatagagactaccacgtccattcttattttgttggacggtccatttttaaggatcaagaagataactaaaattttgactttttaaatgaaagcggagaaaaccaacacatttttatgcttaattaggtcttttgctaaacttcacaagagaatcgagttatgagactacgtacgatgatgtgataaaatctctcagaataaagttttcatgacaatgacgtatctcctaacttataatattagtaaacaaaatccatttgattatcagaagattagaggacacagctaatgctatgctaatgtgaactgcgcgtaagacgcgcttaatcatttgtcaatgtgtaaagcgaaaaatattaaaaatatgaaacacgagtccgagtaaagtgacgatagtaacgacgtaagacgagaaactctggtctacacctttataaagagataagaaatctctctctccctca

SEQ ID NO: 878 - DNA, 579 bp, Arabidopsis thaliana
  misc_feature (1)..(579): Ceres PROMOTER PT0861 As Stated in Report Number 300
agaaaaaaaaactcaattcttacaaaggaaaacatctggtgaaaacaatggccaactaagttgtaagaccatagatagtaaactatgtgggccatcaattaatattattcggacagttagtgaaaattagcctaattaggtattctaataacatttttcccattcatcatttagcatatgtatgtagggtctcgccatatattagtatacatttttatcccctgggaggatgtgtgtgagctgtgaaagactgaaaagagttggtaaagtagtgggtttagtttctttttccagtaaaagtggttagctttttccctctcgtgctggacctatctctttggttttatcatcatacacttcgttaaagaatagcgtaaatagtaaactcgagagtctaaacaaattattggcaaaatgtgtaattaaatatgatggaacggccgacggcggctaaaacgtgtatcagtgcatgcgtagtaaagccatccctcattcatttgtttaaatatcaatatagagcccaaaaacaataaaggaagcattaaacacaagaatagagagagaagaaagaagaagacg

SEQ ID NO: 879 - DNA, 1000 bp, Arabidopsis thaliana
  misc_feature (1)..(1000): Ceres PROMOTER PT0760 As Stated in Report Number 318
tacatacataacatgcgaatgtcttgtgtctgtgtatatgatatctaatgtatgggaaaacttggaatataggttttattttcttctagacaagatcatgaagtatagtacgtatcttttatgatcatctttttggtcagacgaaagaatattagttttatataatacataatttgtgatttgtttttctatcctctataagcacaaacatatactatcagattatgacacatcaacagtgctaatataacattaggctgtaaaatcaacttaaatattttgtaacacttttctcttaactattacaataaacgtatagctgttagtttgcaaggacagcgttaacaacttattgtatcatagtattgattcaaaacgttaattactgtgataactataacttattaactgaaatgcagacgttgacagacacacaagaattgaaatgtagaaacgcgtttatataagagaacgctaaatatataaatttcggacttttctagtgaaactctattagtcttcttttttttctttggtcaaaaaacttccaatacgaaattcgaacaagaagtataattagtgatcaataatgcgaatgatgcaataaaaagtcaaatgaaatgaaattgatgaatttaactgttatataaaattataagttgacagaatgaaatagtcatataattctagttctagacgtggatagcaaaaactttgtcgcccatatgtatataaaatttgtactctagttatcttttaagtatataaggcttatattatacatcgaagtcaatggttctttgtggtctgggtctataatcacaggtaagcacatcgtcatcgatttcattttcaaagtcaagaccaatctcgctctctatataattgttaaaaaccatctttctaattaaaatagaaagagtaaaagccaagtaacaccattttaaaaggcttcgctttcaattcagaaagaagagaatagagagcttcttcttcttca

SEQ ID NO: 880 - DNA, 436 bp, Arabidopsis thaliana
  misc_feature (1)..(436): Ceres PROMOTER PT0878 As Stated in Report Number 319
ataacaagtagcggggatagctcagttgggagagcgtcagactgaagatctgaaggtcgcgtgttcgatccacgctcaccgcatttgtttttgttttttcgcactcgattagtgggcctggacttcgaacaaaatattcgataaggtccatttattttcggatttggcccatattaatcaaataagttgtacggagtattttaatagctcaacaagttctgacaatccttatagaacatggccgatcggatctataggttgattgattgcttttactttgagattatttagagatttatataatgcgacttgcaatagtacttattgacttacattcaaaaaatttgactttctaagccaaagacattactatatgtaaaagcttcagatcgtgaatcttgattaaaattatctgagtagcaagaattcaaaagaa

SEQ ID NO: 881 - DNA, 999 bp, Arabidopsis thaliana
  misc_feature (1)..(999): Ceres PROMOTER PT0513 As Stated in Report Number 137
ccaaaatatctagagacccgtggttctatatgtacattttaatttttaatttgctaaagtcagccatgaatactatagtatacctagtcagatttgatgatgatggttgttaaacccaccgctcctcctagtcaaacatcttctacaatttccaaacacattcaaaaaacgcagaaaaaaaaaaaaaaaatgtgtatatgtgttacaattcttaaaagaaaatgtaaagccagataattgttacaagagatgtacaaagctccaagtgtgaagaacatcaacatgaatatgatccatgaaatctaccaaatttccgtgcttgcactttcccatacatttttgtttttcacctaactcttacgaacctaaaataaaataaaatacaaaaaaagggagaaagatttgagcacttgtcgacacatcgtagcatcctacctctgccgacacgtggctcgagacaaatacggaactcccggtcggaacagaaacaaatacttattttgactacctgaaattcgacacgtcatcaccttctagactcaaaagagtacaaaggccaatgagactctaccattcctaacgaagtgtcacgtcacttcctatcaaacctttccttaaatacgttcactgccgcgtcactcctcttttttggtcacgtttcctatttttgtactaatacttcttcttctctctacacatattttgttggtaatcacatcgaagattcgaaattggatcacatttggtaatcaacttttttttccaaagtctccacgtgtatggacgattacatacgtacacttatttattttcgctttggtggataaactcgatgttaccaaaagtatacactatctaattaccgaaccaaaattaatctgaaacccttctatatatatatactttctttgcaataacagagtgaaagcaaacattcaaaaaaaaaaaaaaaccattttttttttcttactcaaatcttttttagtatcattctccaaa

SEQ ID NO: 882 - DNA, 1000 bp, Arabidopsis thaliana
  misc_feature (1)..(1000): Ceres PROMOTER PT0590 As Stated in Report Number 152
attattcaatttaataaaaattgagtcggccaatttaatgcgagacttctgtacaacgaccctaaaagtgggtttgataaatgaaacatattgcaacaaaaaaatactagtaataatgataaaatagtaacatgtcgtggcgcattgaatatcctacgaaggtttagtgtttacttttaaaaaatcctaatatgatactagtacatatagctagcttgccttgcttatgctattgcatagtctgtattaataaatgatgttatacatttcgatagagtaacattttgggaacatgagtgaacgtgcttgaatcttcgtgcccttgacgtcagaagctagtaattttaaatactaattaacattcatacaaattaacagatacaatgtactatatcataattcgtttccgtaacacaacgcaacaatttgaaagtagatgtactttagtacttagttagtgtgcaccaaaaaaaaaagatgtagttagttagtaaggggttaaatgttttaatttattaagaaaacttaaattcattaaatgttagaaaaagtctaattagtttatattcgaacactgtgctcaaaattaaaaagtcaactattttagactatagagtttattaattaataataaattcgataaatcaccgtattattttcttcaacgacaagtagccgtgaagacacgggagcgaagagagataaacagaagatgaagaagaagatcaatgtcataatcttcagggagataaatccgtaatctttattaatcaaggttaatccttttttttttcttcatcttaattctttgcgtcttccttttctatttatcacgagatctgtctttctttttcctcttctttctctctcttctctctgaagacagtacttgtttctgtccggcgttaaaagcttcggtggtggtctcttgacttctctgagaagaagaaaaggaagctgagtctcattttagattcagctcacgaggaagtgacgacga

SEQ ID NO: 883 - DNA, 633 bp, Arabidopsis thaliana
  misc_feature (1)..(633): Ceres PROMOTER PT0850 As Stated in Report Number 191
aaacctgttattatcggtggcgtacccaatcaattaccgactgcagccggtcgcagcgtctattcagccgacctaagaaccggtatcgccggtatcaataattgctgatcttttccttctcttcttccccagattctcaagtctctctaacttggagaggagatagaagacatctcatcatcaatctccggatccaatccaattctgcatcgactcttcagaggtatttccgatgaaccattattttccccttgtagaaattattctcctttctcaattgatgattgtccacatagctagattttgtgtaaagagatattttgtattatagattgcatctactgctattgtttcccgattgattgaagcaagtagacaagaaaaggattcggttttgtctggttctgaaatttccattggttccaaattgtcatccttgatgaagaagatactttgctatctattagaaaccagaatggctcgtgtattgcctgattctttgtttaccttttgttgattagagtgattttgcaattggagatgttagatgttctctgtttgttttgtggctactaacccaagaaggtttcttttcagttttattgggtcattggagatttttttcggttgagg

SEQ ID NO: 884 - DNA, 999 bp, Arabidopsis thaliana
  misc_feature (1)..(999): Ceres PROMOTER PT0723 As Stated in Report Number 212
gtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgtattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaa

SEQ ID NO: 885 - DNA, 1000 bp, Arabidopsis thaliana
  misc_feature (1)..(1000): Ceres PROMOTER PT0769 As Stated in Report Number 258
ggaagctcaccatgtcttcttcgatttctttccgtccaaattgaatggactgtcgctttaaatatacgtagcgtaaaatgaattgatgcgtcttcgagaactgagaagtggagacaatacttagcaaagcagagtaatccaaagtaaaatcttgcatgagaattcgcttggcaagatgttcccagatttgagccgagaatgtgcagctgaaaaacaaatgatcccttgtctcaaatggaacttgacaaaacacacatgttggattgagattcgatgaccaagagcacatttgatcacatgtcacgttgaagttggttttatgtttctaaaaataatgccaaacaataaatgctcgaaactgaagtccacctacaagttttacgagtaggtttgtcatatcataaaaaacaaaatctacgctgtcgatgagatgcaatcatgcaaggtcgttttaaaataaccgtttgtttgtggaagacgtactttaggtagtctttgaataattatttcacaactagtttatattttcacaaatttaatatttaatcttgcaaccagcagcctcatatataacaatataaatatacattttagaaaaatggccaaaacttgtatatatgaaaaaagccaagtccatcgctaaacttactgatcagcatagcagtctgttcatcttcagaggtcagctcttttctctttccctcataagcatgcttacttcttattcgcaccaatgttttaaccttaaataagatcttatcgaaatctattatttatgtgaacgtaatgagcatagttttagatatcctcttacagtagttccgtttctgcaattggtgatcttaaatattgtgttggttcttcgcttgacaatatgttttgtttttttaatattcccaatttaattaaggaacacatgtggatattgatgcagattattgtactaggaaacacaagaaccacttcatatccagctgaatattgataacatcagttcaag

SEQ ID NO: 886 - DNA, 1000 bp, Arabidopsis thaliana
  misc_feature (1)..(1000): Ceres PROMOTER PT0614 As Stated in Report Number 293
ttacaaagtcgcgatgcaacaacctttgtactatatgatgagaatataatataaaaatgggcaacaagaacaaaagaaaatagagaaaaaaaggaaaggataatcttccacctaaacaagtccaaagaagattgcaagttgcaacatccacttgcttcgtccggcgtaagctctttgataaggtctctcaccgtcctccgactttctctctccatacatacaccacatttacatacgccatttacacatatatgacaaacccatcaacatctgtgcatgcacgtgtgctcatgcatgtatgtagtttttacttcgccatgatgaccatgtctatcttaaaatttaccacaatcaatcaatcatgcgcgttacagtcgtgtgatattcaaaaattgtacatgttatttctcataactatcactttagtagattaagatcagaatgtgcatataataagtaaattttaacaataacagcaacatattttactataactaatgatttatttaaaaaaaaaagataaaactaattctgaaatttcagttttttctatgaacaatttattaacagtattcatatgtagataaaccttgtagattctataatataaaatttatcaagatggaaatgagggatctatagaatacaattaattttggtgatatatattcaagataatgaaggaggcgtctgaggaaagaaatcatgggggcataagatggtacaatgtatcatacatggtcacacacatctatatgatacaaatgcgtctatatacacaactgtttctatatacatacaaacacaaagccttcacatccccagctatctctatccatctatcttcaaatatatatttttaaaaacacacaatgttcatatcttattgttattgttataaaataaaagatgatcatactttttaaatttctcaaacaaaaccaacttgacaaccgacagcgaacaagatcaaaaagctagctctcttcttttctcatca

SEQ ID NO: 887 - DNA, 1000 bp, Arabidopsis thaliana
  misc_feature (1)..(1000): Ceres PROMOTER PT0621 As Stated in Report Number 294
tttgatctaaaaacataagaaaataacattattagtaagtaaagacacttggtttaagtagtaaactccctaatggatctagtttttcactttccatgtcattttcaaatattatatcgactaaaataggtgataacaaaaaagtaacttatagagagaaaaaaaaattagttcatgttggagacataacttttgctaatttaaatcaaagatcaaatgaatttggtttgcttttgggactatagtgaccacacatataataaatagtgtgattccacgagatttgttattggttaaaaggtaaaattgaaaaattgcagatcattttgtctttgtgcagattgccaatttttattcccaacggattggatttgccaattcaaagtcaacagaaattgtaattaaaaaaaaaaagaagcatatttgagttagtgatcaggatagacctatgatggctaaagactttctagaagaatatgaatatcaaagtagtcgtctataaatgatgacggctaagactagtaaacataaatttgttaattttttcaagtaattttttcttcgtgtgatcacatatcattaacatgttccaaattcatggtcctcttatcttgaataagattttagtatgtattgtaaactagctcaaaacattaacatttctgtaataaacgagtgaatgaaacttgccggtgaaatagtaaattataaaaaagagatatgaaaatgaccattttagatgaaataaaagatacttttcatacatacatatacagagtttaggaccatttcaacaacttcttcgaagtcaccgaactattttgatttgtatgacctttcacttccatctccaattggaaacttctgaccgtccacgtggcattcaataagtaacacatttgcttatgacatatcccctaacttcctcgcttcttctccacgactttttcaaacttttcaaaacctccctataaacttcagatccttattcctcacaata

SEQ ID NO: 888 - DNA, 1000 bp, Arabidopsis thaliana
  misc_feature (1)..(1000): Ceres PROMOTER PT0693 As Stated in Report Number 295
tctcggatatcccaatctgagtatggttttaggtcaattcaacatagtattattttgtcaacaagcaccattatagcaaaaacaaagatgtatcaaagaaaagtagcgttaggggttggtcagaaaaagacatgtttgcagtgtaagaaatgacgtggacacgtggaatcatacgcaatgcaacatgtcatcattaaggtccattgttcaacttacccattgagaacaaaactagaaaaattatagaccgttggatcatctttaaggaccatgtctgattcacgtatctctctcccacttggaatatgcttagcctatgtatgggacacattcgctaggtccaccagtatcctgtacgcaaacgcaacatcgagaagcttccgtttccaatattctatactataattacaaatgttaaaaattgtttataaaatttgtaatttgacttgtagacatcattagggtaaagatatatcaagaaattacttttttcataggaataaaaatagtcaactctcttaaataagggacaaatacaatcctctaatgacctggaaaacaactatgcaatcaacattaacaaatgtaattagaagtacaacacaatcaattttggttaaaaaattgaaagtatataaaaataaaaaaataaaaaacgtgtcttagttgataaataactcattaatcacgcctctatctctctgttttaagagtttaacagttaaagatcttcttctctatcttccttatttgactacatctccgtttattcttgggtctctctctatctctcttatccagatttatcatcgtcattacatataaacatcaaacttaacttttcaatattctcattcactttttcctcttgtgctctaattcttatccggatccgatttctctcatacaaagattctgtttttcttcttgggttattgttcttgctctgtttccgtatctcaaagtttcagctgctgaattgaatttgcattgatcgtag

SEQ ID NO: 889 - DNA, 1000 bp, Arabidopsis thaliana
  misc_feature (1)..(1000): Ceres PROMOTER PT0761 As Stated in Report Number 303
ataaattcattaataacttgtgaatttctgtgtctttgcttctttggagaaaaaaaaattatatgctaaatcaacgcatactagagttgggagttgggcctttaaaataataagtgggcctttaccttgtggacttaggccatatgagcccgagaaaatagattaaaacgattggtgcctttggaagcgacgacttcgtttgacttttcaacttaacgttttcgtctcaaatatagccgtagacaaaagacgattgcgtcaactaaaaggttaaaagagacagaaaattttgaacaaacgtttcaactatatgtgaacaaaattttgatttttttcccaaaattcccattgcatatggaaaaagattttgatttggaccatgattttttttttgttgaattaatgttaaatagaccatggatattgaatttcttttgtgagtgtatgtatgatatgtaaaagcttcaaattgtgaaatttacaatccgtttactcctttgatactatatataaaaacaccaagttattgcaagatggaaggattaagaatttaagataatggccggccactgacaaagaaggttaagctttcattaggacaatgaaagtttaaaagaataacaaaaaaagaaatgcgtgaataaatggagatagcagtgaaatctataaatatctgcataatggatgttcacgttatagttcaactaatgaagctaaattattatttgcgggaattataaatacttctaaataattatgttgacttgcaacttaataattaatccttcattttcacaacacatacagggaactttgcttggccacccagacatattattatttcaataattattcaattgctaaaaaatattagaaactcaacgggcatatatgaagtatggagcctcagtttctatataaagcaactctgccaagtgcattcctcatatacaaaaggaagaaacacttaaaagaaaatatcaaatctaaagtcgatcac

SEQ ID NO: 890 - DNA, 1000 bp, Arabidopsis thaliana
  misc_feature (1)..(1000): Ceres PROMOTER PT1016 As Stated in Report Number 323
aaagcactggggtcgaaaccggtagtaaactagaaatgagagttacctacttaaattgctctcctcatatttccaaagatgcaatcatccaaaaatgttagtcaacggtgaaaacaaaaagaaatggatgatgcttatgcgaatttaaaaggaaataatagttatattatatggataatataattaggttttgaatgtgatcttaattttgttttgtgatacacagccccagttcagaaaatattaagaatttgccactgaacatacgtatcccttccaaatcactgttgacatactaacatcattttaaaaatattcaataatatcttaatataaattttatgaattaattaaatcgaacaaagcctttttttacccaagataaacaaacatttggatagcttgtaagttaattatagtagttttaggcactgtaagtatcccgcataattcatatattattagtgatttggaaatttagcaaagggagtaaattataaaaaaaaaactagaatttacacaaattttgataaaagtcatgtcaattttttattttttttaaaggagatgttaaacatcactgttcctaaaaaaactttttaaaatatacggaaagacaatggagaactgtaccaaaatacacacattttggagaaaaggaaaaaaaaaaaagcaaaagaacacacacattttgtcagctgatatatatggatcgatatttctttgaatgcaataagcaataaatgtgcctaacatattctttcattatttttttttaatattctccctactaacactattgcttttctctcctttcttacgataaagatataataatgttttcacaaaatctttttacaaaaagaaaagaaaaaaacacattgaaatcttcttcctataaacgtctcttctctctttcatcactgcaagaaacttaatcacaactctctctttaatctctttgtctctctctctctctctctatctctctctcatttta

SEQ ID NO: 891 - DNA, 1000 bp, Arabidopsis thaliana
  misc_feature (1)..(1000): Ceres PROMOTER PT1026 As Stated in Report Number 324
ccaaactgatcatttgtataacctttcttgaaaatcatagatctatcttaaaactaaactgtaagctttttttttacttttcaattccctaagattatgtctccactttaatattttaccatttctcttaaacagaaaaattgaatatacctatttataagtattcaaaatttatttttaggtagaatttagcgcaaaagtttattaaactttacgtttacaatctcattatttaatattcacgtgaatgaatattttgacatggtaaatataatataacactataaataatatatttacatatgatgaaaagaagaataatttgataaattagaaattcacataatacatgaaataatcacatattaattccaccctaactagctaaatgataaaaataaaatcatataaatcagttcataaaacaaaaaatgtctcgggaaaaaaaaaacactcttccaaaagagacatgtaatagtcaatttatttctattttcataatcatcgttaatcctcattgcatgtggtacaattattctaataagaaaagtgaatcgtcccaataaataatcctaaaatgccgtcttaaaaaaggcaatctataaaattatttataaatatctaagaatgagttgtctactttccattgattaaaaagagaaaatatcataaacaaaaaaaaaaagtcagagaagttaaaccaaaagcaacaaaaaagaaaaaaagaaagaataatcaagagagaggagaagaggacggtggaagatattttgcagttgaagaaaatatctttgatattttttgtgtttgaaatatctaaaaccaaaaagtttcatctcttcattccgccaaattgactggtgatgacgtggcaactttacccacgtgtaaaagcgtctacaactgtatcgtttcttttgatattttgtttctctctttctctctgatatttttcattttcttcttcttctctctctctctccacaaagataagccaaca

SEQ ID NO: 892 - DNA, 250 bp, Arabidopsis thaliana
  misc_feature (1)..(250): Ceres PROMOTER YP2532 As Stated in Report Number 519
ttgtacggagtattttaatagctcaacaagttctgacaatccttatagaacatggccgatcggatctataggttgattgattgcttttactttgagattatttagagatttatataatgcgacttgcaatagtacttattgacttacattcaaaaaatttgactttctaagccaaagacattactatatgtaaaagcttcagatcgtgaatcttgattaaaattatctgagtagcaagaattcaaaagaa

SEQ ID NO: 893 - DNA, 2378 bp, Arabidopsis thaliana
  misc_feature (1)..(2378): Ceres PROMOTER YP2573 As Stated in Report Number 696
gcatactctttgatattgacatctaaagtttgtactttgaagcaacaaaaacgctctattttgcctttaccatgcgtaacagacttcgtctttaacttatatttgtttatatatttatttctgattgacacaaatcaaacatgtgctatttcataaagtcatttaaagttagctatttgttagatatctaattaagcacaatgaaatgaaatacaaatacaaatgcgtataatcaaacgctgacgtagaggaaatgactttaactatcgtaatagtaggtgttggtaaacaacggtgaacgaactataacttgatagttacaaatgatatatttaaaagtagatatcatagtgtttgtgataaaacttttttcaaaatgtaattcaaacaatttgaattgagtaggttgttgcttgaagtaggcgttcctcattatacgaatcttttgcgtttctctttgttttcatgccacgtgttgtctctaccgctcacacgccacaagaacattcttgaaaaggcttatcaaacaactttaagaacatatttctattctacccaacagtaagaaaaataaaatatatcagttatttggtttgacatagctagcgtccaactaattagaaatgatcagtttatttacattatcatccaagaaaatgcattgattcataatgattaatacaaattttcattggttattcatgggtacttttcttaccattaatgctaaaaaataaaataaaattcaccaatgtacaataagtttcttaattagcacacttttttgcgtttggtcatctgttttatgtttggttttataagtatagcattacaattattattttagctttaaaaacttaaaatgtaaattttaaacacgtgaatgtgcaagttattatgcatgtggttaataataaagggtacatgtgcgtatgagctgtgaatgtgcgtatatggcagtggacagccgtaaatgtctgaccaaaatcgttttccttatctttttacccaacagtactactactgccttaggttaaaactcatcttgtcggacgcttcttcttacaagtttacgtcttttatattctaaaattgtaacaatatattaagtttgagaaatctttcttattaattattactacgtcatttttatgtgttaactatttttgtcgaagacttttttattcttgatcaattagtccgaaaatcactactaattcgtaaacaaatttttattattaaatacctctctgtttttcctcatttgagaacgtgatataaaatcaacataatcgaatcttcacagttcacactagtttatcattataataagtgaggggattacattttaggtatttagagaaaacggggaaaagataccaaaatatcttagagacccgtggttctatatgtacattttaatttttaatttgctaaagtcagccatgaatactatagtatacctagtcagatttgatgatgatggttgttaaacccaccgctcctcctagtcaaacatcttctacaatttccaaacacattcaaaaaacgcagaaaaaaaaaaaaaaaatgtgtatatgtgttacaattcttaaaagaaaatgtaaagccagataattgttacaagagatgtacaaagctccaagtgtgaagaacatcaacatgaatatgatccatgaaatctaccaaatttccgtgcttgcactttcccatacatttttgtttttcacctaactcttacgaacctaaaataaaataaaatacaaaaaaagggagaaagatttgagcacttgtcgacacatcgtagcatcctacctctgccgacacgtggctcgagacaaatacggaactcccggtcggaacagaaacaaatacttattttgactacctgaaattcgacacgtcatcaccttctagactcaaaagagtacaaaggccaatgagactctaccattcctaacgaagtgtcacgtcacttcctatcaaacctttccttaaatacgttcactgccgcgtcactcctcttttttggtcacgtttcctatttttgtactaatacttcttcttctctctacacatattttgttggtaatcacatcgaagattcgaaattggatcacatttggtaatcaacttttttttccaaagtctccacgtgtatggacgattacatacgtacacttatttattttcgctttggtggataaactcgatgttaccaaaagtatacactatctaattaccgaaccaaaattaatctgaaacccttctatatatatatactttctttgcaataacagagtgaaagcaaacattcaaaaaaaaaaaaaaaccattttttttttcttactcaaatcttttttagtatcattctccaa

SEQ ID NO: 894 - DNA, 1000 bp, Arabidopsis thaliana
  misc_feature (1)..(1000): Ceres Promoter PT0960
  misc_feature (781)..(789): Motif name:GLMHVCHORD
  misc_feature (909)..(916): Consensus TATABOX
  misc_feature (956)..(1000): 5' untranslated region
ttataatatgaacagactcgtttgcaatttgatgcgtctcgcactctcgagtttttcaaacattcatctatatatgtttgataccatcacgccactaagatgattggctttaagtggatctaggaaacttctttactagcagaaaacatcaatattctaatccttactttagataaaatattatttataactgctactaaaaattaccgcctaataaagcaaatttaaccaatctgataccccaaccccaagtgacattcactctaaatggtgaaggtaaataccaatatatttagagtatttatccaaaaaaaaaattgccaatatatttcatcccagctataagatattattttcattcactagactttatttgacttggtaaaaacatgttacctaatgcaaaatttctaaaagcacattttagctatccgaccacaactctcgcaattaggcttcaggaactatagtagtttttggtaaaatttcttcattgtcaactctttaacactataaattatgtacaaggactaaagtcactttatgctacatcattacccacaaatttcataaaccattggattatcgaataattacgtatataaaaaaaataaagtacgctcttaaaaaaattagatatggttgctcgaaaagaaacatggtgcgtcgacgagtcgctacctctcacgctttctttgaataatttataatatagtctttgattttctccgcaatggtccccttcatgccatctacttactttcacctttcaagtgcttcatgactcatcaatctcacgattagaacttctctttttcttctccttctattttattaaaatttacgtatgcttcagccacttggattagttattagtgtaaggtaacactactttcgatttattcatctataaaaaccaaaattagagtgcatttcattgatctataccatcatacttgtcaacaaaaattttcttaaagaacgcataactgtttttttc

SEQ ID NO: 895 - DNA, 400 bp, Arabidopsis thaliana
  misc_feature (1)..(400): Ceres Promoter YP2585
  misc_feature (54)..(61): Motif name:PROXBBNNAPA
  misc_feature (131)..(137): Motif name:ANAERO1CONSENSUS
  misc_feature (198)..(202): Motif name:ROOTMOTIFTAPOX1
  misc_feature (233)..(239): Motif name:TATABOX4
  misc_feature (263)..(400): 5' untranslated region
  misc_feature (151)..(400): Ceres Promoter YP2581
tcctaaataactttttctagcggagagtgtctttccaataatttaataaaaatggtgtttgtatatcaaaaaaaaaagaaaaaagaaactgatcgagatagaacgtttgcagttttataaacaatttaaaaaacaaaaaaaattaaactcaatgtattttttattaattcacaaacaataataaatcataggatcgaatatttacacggtatcaaaacctactcgccgctactatataaaaattgaagtcaaatatcaaccgcaattattaaaccagccagaccaataattcataaacttaatataaacataaataaattaatgttacacaacgatatatggtagggttattactatcttcttcctctcaaaacacatctcctaaccttaagctttagac

SEQ ID NO: 896 - DNA, 1251 bp, Arabidopsis thaliana
  misc_feature (1)..(1251): Ceres Promoter PT0998
  misc_feature (178)..(184): Motif name:ANAERO1CONSENSUS
  misc_feature (185)..(191): Motif name:ANAERO1CONSENSUS
  misc_feature (199)..(209): Motif name:ARE1
  misc_feature (277)..(283): Motif name:ANAERO1CONSENSUS
  misc_feature (313)..(319): Motif name:ANAERO1CONSENSUS
  misc_feature (992)..(999): Motif name:NRRBNEXTA
  misc_feature (1077)..(1082): Motif name:TATABOX5
  misc_feature (1168)..(1250): 5' untranslated region
  misc_feature (1014)..(1170): Ceres Promoter PD3457
agaatatttctactcataaacaataagaataattcacaatatcacatgctagttatttagtttaagttttaccaagacaaagagctggtggattactgtgaaaatgtccacttatgcatattaaaaatttggtagactaatcgactagttgctaattgttccataatttcacaaaaaaaacaaaaaacaaataacctagcccagtcaccactatatcattgtggcagatttattaaagttagccttagcccccaacataatttgaaaaggcaagcaaaacaaagacaaacttgcaaaagtctaatctttctgaaacaaaacatataaattaaaatattaatttgtttatttaaatgcaatgtcgtattgaaattaaaaatctcaatgttcttgttgttttgtgctaagttctgaaaagttttgaataacaacacatacaaagtactctgttacttatactgtaacttgtaacttccattacagagagagagactacactggctctataatgtacatgaagatgtgtaattgtgtaatttctcttgtattaatattaacttcacctgttcttgtaagagataaactataaagcattaaaggaacttgctttaggtgcaactaaactggttttggacaagtgtagcaacatgaaacatgaaaattcaaagggtaaggctccacctaaaatttataaagatgtgatgcaatgttccaaattatatctacaaaatatttgtttcgtgtggaacaagccctctttcatatgaatagttctacacaagcatgaattagatattactaattaaactattaaagaactcgacctacaaaactgtctatatatttccctctttcgaattacgtatctgtgtcaaagattgtcatcaccaatctacatatttttattcatcagtaccatacacgtatatataatatatctatttcaaatataaaaaaaaaactttggaaaaataaaacattgtctggttttatagtggattaggtaaaaccaaaaaaagaaaagcttacttgatccaacatacatactaactctcaacagatacaaacacaagtttattatttaccaactcttatctcaaaagattcttctcaataatttatcctcctttgacccctatatagacacacatttgacaccatatgtcatgcacaaaacatcatcatctcttgatctatctttcagttctcttgtcaattttcccccaaaaagaaaaaggatataagaagata

SEQ ID NO: 897 - DNA, 730 bp, Arabidopsis thaliana
  misc_feature (1)..(730): Deletion of Ceres Promoter YP0286
  misc_feature (1)..(730): Ceres Promoter YP2219
  misc_feature (505)..(509): Motif name:ABRELATERD1
  misc_feature (627)..(635): Motif name:TATABOX4
  misc_feature (667)..(730): 5' untranslated region
  misc_feature (542)..(730): Ceres Promoter YP2229
attatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaa

SEQ ID NO: 898 - DNA, 1000 bp, Arabidopsis thaliana; identical to SEQ ID NO: 825
  misc_feature (1)..(1000): Ceres Promoter YP0286
  misc_feature (142)..(146): Motif name:ABRELATERD1
  misc_feature (148)..(157): Motif name:O2F3BE2S1
  misc_feature (149)..(155): Motif name:ACGTOSGLUB1
  misc_feature (151)..(155): Motif name:ABRELATERD1
  misc_feature (372)..(379): Motif name:RYREPEATVFLEB4
  misc_feature (774)..(778): Motif name:ABRELATERD1
  misc_feature (926)..(930): Putative TSS element
  misc_feature (897)..(904): Motif name:TATABOX4

SEQ ID NO: 899 - DNA, 1000 bp, Arabidopsis thaliana
  misc_feature (1)..(1000): Ceres Promoter YP1692
  misc_feature (737)..(741): Motif name:ABRELATERD1
  misc_feature (62)..(67): Motif name:ACGTTBOX
  misc_feature (523)..(528): Motif name:ACGTCBOX
  misc_feature (553)..(559): Motif name:ABRERATCAL
  misc_feature (568)..(574): Motif name:ABRERATCAL
  misc_feature (810)..(817): Motif name:INRNTPSADB
  misc_feature (867)..(872): Motif name:TATABOX5
  misc_feature (901)..(905): Putative TSS
  misc_feature (905)..(1000): 5' untranslated region
  misc_feature (813)..(813): n is a, c, t, g, unknown, or other
ttgagatctcaatacgaaaatgaaccctttcgtttgatttatcaaagccttttattttgaaaacgttaaatcctcactaggatctctctttatattaatggttaaaaacatatgcatgttttgtgtttttgcatcttctttttcatagacaaaagcaagatgagtcttagaaggacatcaatgtcatagacatggctttagtatcttttgagtgtgctttaaatgatgatgatttaccctgaacctgaaattttacctattaattaatttaagtgtgcgttaaaccataaaccatatactctgaacctgaaattggttctaaagcacaacctaaacttgagattggagaatgctttaaaaggaaaaaaaaatcaaaggaaaccattaatgagccatcaaaaaatattcactaatatgacaagatgcattgtttatttttcttttcagaatcctcagaaactaccactaaactcctcaaggaacaaaaccatatcatgaattaggctggcaatttaactctgagacgtctttcttgtatagagaataaaacatacgcgtgtaaaagaaaacgcgtgaatcgaatgatgagtgttaacgttcgatcgagatgccaccaaatcttttcattaaaatgaattgtggaggacataccacttttaacgaggtcatttccactgggtgacatgtggactctactttgggtggcatgttcatatctttccacatcaccatgtaaacgtgaaaacacccaccacactcacttacatctcaaacacatgtcttcattatcgtacgtagctccaaaaaaaaaantgaaaactaggtttagtgattctatttcgcaatgtataatatacaacttgtaaaaataaaatatttgaataagcattataaataaacccaaagaggtgttagatttatatacttaattgtagctactaaatagagaatcagagagaatagttttatatcttgcacgaaactgcatgctttttgagac

SEQ ID NO: 900 - DNA, 1500 bp, Arabidopsis thaliana
  misc_feature (1)..(1500): Ceres Promoter YP1894
  misc_feature (156)..(163): Motif name:P1BS
  misc_feature (512)..(519): Motif name:P1BS
  misc_feature (836)..(844): Motif name:SURE2STPAT21
  misc_feature (1245)..(1268): Motif name:PRECONSCRHSP70A
  misc_feature (1389)..(1396): Motif name:P1BS
  misc_feature (1452)..(1456): Putative TSS
  misc_feature (1425)..(1433): Motif name:CONSENSUS TATA BOX
  misc_feature (1455)..(1500): 5' untranslated region
tttttatgatcgcaagaaacaattgttatgttattggtgtaatgttttgtattcttcattttatatattcatattattaaacattattctctatgaattttttatatatatagaaaagttacatagtgtaaattatatattagaccgttgttctagtatattctaatctggttaataatgaacgtttgcgtggcctaatggataaggcgctcgcctccgaagcgggagattgtgggttcgaatcccatcgcgaacgtagttttttgttttcagcaatttgcttatttcgttgaaacttggataacaacattcatatgtggctcttagtcgacgaatatgtatgcgtcggctaatttggaaaatctgatagcggcatcccaataactatactcgtaatttagcaagatgattacatgcataaccactctgacttataagagcgagacatgtatatagtgtagagtgtacatacgtaagcaaacatcaatcaattttgtcttgattggtgatggtatattcattttttatgtagcatctctagatgctttcggataaaggtgatatgaatatgtttacaagaaagagaaagaaaatgatatatttctgaataatgtttttttggataaatcctcaataatgttgtttcgaatctatgatctctacaatattattaaacatatatacctacaaatttagcatctatacgggtaagacgaccattcatatatataagggatcatgaagacaacacaaataagacatccacaaataaattaataagccaacttggtcttaaaaatcaggcatcttattcttaacaaactttagctgatcgattagtatttgcactaaccaaagaaataataatttagtttactaacataattgcatatatatatatattatacaattagtagagtggctataaagcatgccacatgcacattctttaatggacagacatttgaatattgaagagtttatcgtaaactaaatgtcatttgaaaactgctaaaggtcttttattttatatactcacataatcacatcaagaatatgacttattatattcatcgtttttggtcgataataatgattctttacaataaggacatgttgagcatgtttataacttatttaatttgactcgttgaattgttattattttgttaatatgcttagattccacatctaaaataatatctaatgcagatcatatgtaatgcacattaaaggttttacctccgataatttaatattccaattaattaatatgcaatggcagtgtaactaacggcagccgttagttaatggagtcggttgcttgcttagtttttgttctcgaagcttgacttttgaaacagaatgctgtttaacctccttaaacggaatattctcttttttagtactttgattctattcctctatataaacctctctctctctcacgaatcagagatacgaagaaactaacaacaacaagaaaaaaggaatattccg

SEQ ID NO: 901 - DNA, 999 bp, Arabidopsis thaliana
  misc_feature (1)..(999): Ceres Promoter YP1976
  misc_feature (90)..(99): Motif name:CARGATCONSENSUS
  misc_feature (202)..(210): Motif name:HDZIP2ATATHB2
  misc_feature (454)..(463): Motif name:CARGCW8GAT
  misc_feature (479)..(486): Motif name:P1BS
  misc_feature (491)..(500): Motif name:CARGCW8GAT
  misc_feature (742)..(751): Motif name:CARGCW8GAT
  misc_feature (945)..(951): Motif name:TATABOX4
  misc_feature (972)..(999): 5' untranslated region
agttcgactatagaatacaatacaaaggacacaaaatcttcatgtacaatcaaaaattatcaaccccatatcttatagttggaaacgatccaaaataggttatataaataaaatatataaaatatgtcaagtataacaactcacatcacccttttggcttttggggaaatatcggatttatagaaaaaaaaaaataataataataattaaracaataaaatatttggtctgaatcttttttgagatactgttgtatcataacaatatcttttagagtcattcaacatcaatccacatgtattgcactggaacatgcattttaataaggttctatgtttgttaaattatgcagtcatgtaataatcaaattttatgataatgtctttgtaaacgctataaactaaaaatttataatagttacatgtgtaaaaaatgttgtcgcttaaccatgtcatatatatgttggttggtatacgtggatatacgatacatataattggtgtagttagctctcatttttttttttgttttgtacattatcgtcgtacgtcgactttgtatactactttatactccgtcaaactaaaataacttaaaatataataaaattgtattcattatattcacagaaaaataaaaatgttattcttgtaacaagtcaaactaaaaaaaagggaaaataagaatgactaaatgtttatgaagacgaaagagagaaaacatttttgtatttttattgacattttttagcagtcaagatgttagggtgaggaaatgaaaagttaatagaaacatgtatagtaaaagagacatttttttttgattgtagatagtgaatgtacgagtatactatcccccttagatttaaaaaaaaaaaacattttgcagaattattcataaactaaaatttagaaaataatgtaggagttaggtgaaccgcttatatataataaagacccaattagtaagtagatcaaacacaaatcaaatcagccatac

SEQ ID NO: 902 - DNA, 1000 bp, Arabidopsis thaliana
  misc_feature (1)..(1000): Ceres Promoter YP2016
  misc_feature (349)..(978): Intron
  misc_feature (207)..(214): Motif name:P1BS
  misc_feature (260)..(268): Motif name:TELOBOXATEEF1AA1
  misc_feature (978)..(1000): Motif name:5'UTR
  misc_feature (294)..(300): Motif name:TATABOX2
  misc_feature (327)..(348): 5' untranslated region
attacattctcttaacctgcaaagtgtatatcgtccaagtaaaaccttcttgatttaattcgcgttgaaccaaatttaattatattccacttttggattgaaactatcaaattcaaattagcttgacttatgaaacaagagcgacccctcgaggttagtggacttttatgaaacgcgaccgactcttcaaggcccaaagaaaaagagaatattcggcgggataggggtacgtttgtaatttggcaaacgatgttatgttaaaccctaacttattatttctttcgattcaccactataaataaactcgaatcccaaacatagctttattccttgcttcatttttcgtcaccctagccgctttactctcttgcgatatctctgaggtaagctttttcgtcaccatcttcgatctgcttctttctcttctgttgatctgtgttgaatctgtttcgatccttctcgtttgtttgttgtaatctcttggattcgattctctttgtttatagatcgtttggaatttctgatctgtggtgtaaagttttatcgatttaggagaacaaagttttacagtgccatcgtattgttttttttcttcatgccagctgatgataaactatatgatcgatctggttctgaaatttttgtattgttcaatggattgttgattggatcttttgatgtatgtgatattaattgtcgatttgaattgtgattaggtaattctggagcagcataaacaatcaattgattcattcttcttgataccaagttgtggaaactctaggattgtttgctgtatatctccagaattgctgttttgattgaatttaggtcgcttagctcagttgatagagcaccacattttttgtggtagaaatcggtttgaatccgatagcggcttttaacaatgattgttttttgtgttcataagtctactgtttttcttgattcaatatttgattgttctttttattgcagatttgtttgacagtctctaacc

SEQ ID NO: 903 - DNA, 397 bp, Arabidopsis thaliana
  misc_feature (1)..(397): Ceres Promoter YP2097
  misc_feature (36)..(41): Motif name:DRE2COREZMRAB17
  misc_feature (161)..(167): Motif name:ABRERATCAL
  misc_feature (237)..(246): Motif name:ABREATRD22
  misc_feature (240)..(246): Motif name:ABRERATCAL
  misc_feature (283)..(289): Motif name:TATABOX3
  misc_feature (317)..(397): 5' untranslated region
ccaaattaaatgagcctattgggcttcttgtcttagtcggtgtagagcccaattgttgttttattttttaataatgcaaaagtattaagcgataaataaataagcatcgcaatcgtcccaaaactgtgtgtatgcatcagacatgagcatatagagtaagcacgtgtccacactttttcacaaagttatctaaaaacaaaaaacaattaattagcattcgacgtgtacatatcactcgccacgtgtacaagagccttggcctttttgcttcttcttcttgtctattaatatcatctcctgattatactctcttttgaccaagctgcttcttctccatctatccaacatctcaaatctcagtaatcttgtcccttcgattctgttttggacgtttgta

SEQ ID NO: 904 - DNA, 718 bp, Arabidopsis thaliana
  misc_feature (1)..(718): Ceres Promoter YP2538
  misc_feature (166)..(170): Motif name:ABRELATERD1
  misc_feature (530)..(534): Motif name:ABRELATERD1
  misc_feature (298)..(307): Motif name:CARGCW8GAT
  misc_feature (650)..(658): Motif name:TELOBOXATEEF1AA1
  misc_feature (671)..(679): Motif name:TATABOX4
atgttgaacatctgaatattgtttttttgttctttttattctcattctcttatgtatacattcattactcaattttttaatgtactatactatatctttactcatcaaattattaactttgagactcactaatcaaaaaattctcactactcttttaaacacaaacacgttagatgttaaaattggttgtattcgccctcataaccaattggaaagtggcctaaataagagaatgatgcgacactaaaaagccgaagaaaattctagccatttgagagatgatacaatgagattcagctttaaaatgtatgacctatttattactgacaacaaacgaattacatttgtttacgatctttgagttcacaatggtttgcataaatgtctaacaaatgtcttgagaatttgtttcacaagacaagcaaaccaattgcactcaatttgcataaagtctctaaatagtaaaacaatacgcacatagttcttaagatcacaagataagcaaagcaattccactcaatttgcatatcacgtactatattgggtgttattgaataagttatgttattgggccgggcttcttggtttgtatctcaacaaaacaattatatcaacattcggcccacaagcccataattcagactttcgaaaaccctaatcttatgctcacctatataaactaaaacttgtgaatccgctagggtttacttcatcgaaa

SEQ ID NO: 905 - DNA, 1000 bp, Arabidopsis thaliana
  misc_feature (1)..(1000): Ceres Promoter YP2552
  misc_feature (35)..(42): Motif name:P1BS
  misc_feature (216)..(223): Motif name:SV40COREENHAN
  misc_feature (647)..(653): Motif name:BOXLCOREDCPAL
  misc_feature (710)..(718): Motif name:SEF1MOTIF
  misc_feature (835)..(872): Motif name:TATABOX
acattatgaacaaattcggagatcctgagaatttgcatatcccacgtacacgacctcaaaaccaatcaaattcaaatttcgttctttgaaagatatacttgcaattcatatacgttaaatcttcagtttttttttacacgagaatcagtactcattagcacagcctcattttatgctttcaatgtttttaacacgagaataagaattaggatcaagtggtttgtgcttgaaaaaagtactgactagaacttttttttatataaagagttttccacaaccctcggagacataattgagagaagatcatccttttaaataaatagtcttcactatagtaaattcgatttcattatatctgtcttactgtctatattataagagtatgcacacttggaaacatagggatgctgtgatctccgtttgtaaaataatctatgcacgtacaaaaaaaacattaaacacatttacatatttagatgcatacatgatacagtacatcaatgtatgtatacacacatatactgacactaacacatgcttagtgtgcgcaataattttgtctttactcagtaatttatgtataaataatttggtttagcgcattatatacaactggtccatttgcgcctagcgagtaatggttaatggttggtatgttaacaatttatcccaccagaaaaccatatcttttatcaaatcgcgacttcaaatatttaatatcagtcccacgacatcgacgccgtttaatattgttttatttgttcctttttctcaaattaacatattctagtaccggcaaaacattttttaatatattatgcgtctttctacaaatatatatatatatatatatatatatatatatatatatactcttctaagtatatgatgcaatggagtctctctgcatgaaagaataaaaaaaaaacatcacaatctctttccatttctgagagctaaaaaacctctctctctttctctttgattcaagtttccaaaa

SEQ ID NO: 906 - DNA, 1500 bp, Arabidopsis thaliana
  misc_feature (1)..(1500): Ceres Promoter YP2563
  misc_feature (689)..(695): Motif name:ABRERATCAL
  misc_feature (112)..(118): Motif name:DPBFCOREDCDC3
  misc_feature (653)..(659): Motif name:ABRERATCAL
  misc_feature (689)..(695): Motif name:DPBFCOREDCDC3
  misc_feature (799)..(807): Motif name:EVENINGAT
  misc_feature (1351)..(1500): 5' untranslated region
gagatcttgttcgtaattctgtgataatgtttgataacttctctgcccagtttgtttgaaattcagtacttgaggttctctattggacagaagatgaacatatggactacaacacttggacaatccgtaatggacaaccacacattttggttgcagcgtatgtgtcgttacaaaattgaaaatcaatgtccacgaccatacatgactgcacagcttggtgtttgataattcaaggaaaaagccacataaaggttctatttcttaatcttacattttggaagaaatcaaatcattgatttaagaaataatatgtaagcttggatgctagagctttaggtgatcctgtggccagattaggatattgatttaacttttcttactgctactcaacattgattgtctggtattaagttgtaaaagagtagtttgacttatccatttgtgttgatataattggttattataatgtgattagtcaatagaaaaccttagagtacataatatcaaacttttaactttgttaatttttttaggcgagtgggtgaatacatcagttagacttgcttttgcacatcatgtgatcatcgtttaattgttatatgatcggacggtcattatttctcattaacttctatttaaactgcaaatcttaccacgttcatttgatccgaattaacccattattctacacgtgtttggtacacacaattacaaaccaaaaccaatgaccggttattcttttttcgtgattcagtttatttggggtataatggtctattttcactccaaaaacaaagaaaaatatctcaaccttggaaaatacctgttttgtctaaactttttcccaaagtgccttattacggaacattccctacaaaaaaaccatcgtcatgtactggacaaaatattcttcaagtttgttttcatgttgtgttgggccgtttaattcgcatgtatcccatatcggaccttataaacttataagttataaacattaaaatataatccatttgtcaatccttttttccactttttttaattaagataaatcttaagtattaccaaatcattattaaatttttatatttattattctagctttaccatttacacatactttacccccattgtattttcattgccgaaatgtttcaaaaaaggatgatttaaggggcaataataatatttaaaaaaactgtgtttagtgatgaaacaaaacccgccgttggaaattaaaccagcccatagagagaaaaacctctcttaacgaagaaaaacaacaacatggcccctggtttctcttctctttcgaatctatcttcttcttttatccaatcctttcctatttttattctcaccttctcctcgtttttcccgaaactgttcttttgccctcttctctcaattttaatccaccaaacaaatcgaacagtgttcgataacttttagattgcaagtcctgtttttgatttggtcgggagaaagaaaactagggttttg

SEQ ID NO: 907 - DNA, 2001 bp, Arabidopsis thaliana
  misc_feature (1)..(2001): Ceres Promoter YP2571
  misc_feature (397)..(404): Motif name:ABREMOTIFAOSOSEM
  misc_feature (1231)..(1238): Motif name:ABREMOTIFAOSOSEM
  misc_feature (1558)..(1565): Motif name:ABREATCONSENSUS
  misc_feature (1794)..(1800): Motif name:TATABOX4
  misc_feature (1829)..(2000): 5' untranslated region
aagcgaaacgttatcttatgcaatgtttacatttgcaacaccaattagcttcttttttttacagttgagacttgagagacacattaaagcttgtcatcgttcactggagagagtagagtgtgtgagagaccaagtgacctaacttcactgcaacagtagtcggtaaatatccaaacataagagctacgatggtaacacgtgtacggtggaggaaaagagagccctcagattccgttataaaggaggtgagacccactcgccggaatggaaacaaaggagaaacgtagaggtaaatggttgggccactgcttcaccaaaaagccttttctatcttctttttatttttgttttgtggcttttaacggttaacaatataactcctcattccaagacaattacgtgtcctctgtacggctttttcatttttcactttctacttcatagtgactttagggaggcctcaatttttaattactcgaggattatttaggtaatcatgaatgtaactacagctttacaggtaattaaacagatgagatttagttgcgtgaaatctagctgatctggtgcttatatcaaatccaattgatggagacagatttggacttaaattcatgattgtatttgtaatcttatatacgttatagttaaatttctttctctccgtacgtactctaactataattattattaaatgctgaacgcaatgcttttgagtgctgagaatctttttggtctgattcaaaaatgatgtattagtactctgaattcaatcttaacttctgcaacgaatcaatgtattaatttataggagatccggataaaattatggatatatgcacgctacttctttcatttttaattaggtaaatggttataactttattttatatatcaattaaatgattttggtatgagattactagtacactttctttgcaaatgttttaaacacgacaagacaaaaatattacaagcatattttggtaaaaaatatcataagctttcatatcaaaatcattagttatgatgttagattttttttttttttttttaacactacaaaaagctctggtcttaatatgttagaaattttagtccaaaccagcctacagaggatttagctaaacaattcccaagcaccttttaagtgttaaccgaaataacgtaatatgatgttaaaggttacataaaaacaaaactaaagaattttcatatgaaaagttaacgtacgtgtcttagtgtaacctaattttagttcacagtatataaattctttaatgagatgatcgcaaaatcgctgtatacaatttcgtacttaattcgttagtcttgaaaagttgacctaatttagatcaaattaaggttaactacaataaaaatttaactaacgtaatgggattctttaaaattaaaaaatcgttgattagatagatattttatctttaagggagacacagagacaatttggacaaaaaaggtcttcctgagaaagaagtggaccacaatcgtggcgcgaaaggaacttcctcctcccctctgttgccttgtcattgggccacgtatatctccacctgatcgtgatgcttacgtggtccatttctagatactatagtgaccagatcaacggtcaagattgattctaatttagacgaaagaccaacccgtcacgtcgctagagtaaaagattttttgaaggcggagggagaaaaatcaaaagttaaaagtaatttgaaaacgaggaagagaaaaaggaattttaaaatgtttaatgaagcggtaggccgcatgggtatataaatgggcccgctttgtaacgtgtaacgatgatatttattcaactgcgtggtataaccaaaaaaaaaaagaaacactattcgactctttttttgtttttgtaataaacataaaataaattttggagagagatatttcgtcggaaattaattgacgttcaaaagattcgttaccggaatatttagtagaggcggcgatcgagtt

SEQ ID NO: 908 - DNA, 514 bp, Arabidopsis thaliana
  misc_feature (1)..(514): Ceres Promoter YP2590
  misc_feature (77)..(86): Motif name:CARGCW8GAT
  misc_feature (255)..(262): Motif name:MYBPLANT
  misc_feature (279)..(287): Motif name:ATHB6COREAT
  misc_feature (283)..(288): Motif name:TATA BOX
  misc_feature (314)..(514): 5' untranslated region
agaagggcttgctgtccgttgctcatctcatatagtaaggcccaaaaggcccaaaggcttctttttccaattaaaactaatttttgtatagcgaaattatgatgaagaaaatcgtttcatggcacgtcaaaaaactttcgcacaacaatttttttttacaaaagggtcacttttatcagaacctaatctatcatagagttcccatcaacaaaaaacctatcatagagtctagtcctgtgttaacgtaggtgatgggttggtttcatggtttacatggacaattattatggtgtaagaaaaagatgatgggtacacatattccatttaaccaatgtgaaagattcacatcacctttttcgatttttaatagattcggttttaccttctcgtaacgtaattctaagaaaagaaaacgtcaatcatatttactaggaaagataattataatttattgctttttctctcactctctgacctgaaatctcctactgagatttttgaagtgtattcaaca

SEQ ID NO: 909 - DNA, 1002 bp, Arabidopsis thaliana
  misc_feature (1)..(1002): Ceres Promoter YP2606
  misc_feature (44)..(51): Motif name:XYLAT
  misc_feature (339)..(348): Motif name:CARGCW8GAT
  misc_feature (593)..(600): Motif name:UP2ATMSD
  misc_feature (636)..(645): Motif name:CARGCW8GAT
  misc_feature (655)..(664): Motif name:CARGCW8GAT
  misc_feature (807)..(812): Motif name:WBBOXPCWRKY1
  misc_feature (829)..(834): Motif name:WBBOXPCWRKY1
  misc_feature (840)..(849): Motif name:CARGCW8GAT
  misc_feature (862)..(868): Motif name:TATA BOX
  misc_feature (916)..(1002): 5' untranslated region
  misc_feature (666)..(1000): Ceres Promoter PD3464
cacaacaaaagagagctaatgttttgtaagttagagatgatatttctttgtttatttgttctgtaatgcttgtatatatatatatatattgatcttttctttattattcacatgataaaaacatctaaacagaaataaaaataaaggaaagtgaatgaatgttgaaaaatgtaagattgactacattgatttctatatgcaccttctcaacatgttaaaaataatagcaattaacttaattcatagaaataattattatatttccatgtggtcatgtgtaatacatagatacaaataattattaacgttatcccatggttttctatccattttttatactttaaaaagtgaattcaaagttcaaataaataattatgagattaacattatcccatgcgttgattctctatccataaactctttttttttttttgtcaaacgatctttccatatacatactttaaaagttgtattcaaaggccaacaaaaaattattcccttaaacttgtcccaggaactaaaaattagaaaatatatatccctttccccaaaaatttaaaaaaacctttttcgtcgcaatattttttttttatagggtttatacgggatttgtatcccaaccaggattatataatcaattttttgccccaaaaacaaaataatgaaaaaaaatgaagggtttttttgcccaaaagggaaaaagtttttttttttttttttttttacctttactttaaataaaatatatataagcatacaaactaataatatatgatgcttattgttttttatttaaaatgtagaactttgactatatcaattattttggtcaaagtcttcataattttgtatatatgtttcctataaagatttattatagatcatgtaccatttttcacagtctataaaaaggttatttctctctaccattttcaatatcaaaaagtttcttcaaacaaacaagtattagattaacattatcctcttcattttcagcaatcc

SEQ ID NO: 910 - DNA, 1000 bp, Arabidopsis thaliana
  misc_feature (1)..(1000): Ceres Promoter YP2608
  misc_feature (490)..(901): Intron
  misc_feature (28)..(35): Motif name:P1BS
  misc_feature (67)..(74): Motif name:INRNTPSADB
  misc_feature (155)..(162): Motif name:PYRIMIDINEBOXHVEPB1
  misc_feature (156)..(161): Motif name:GT1GMSCAM4
  misc_feature (209)..(214): Motif name:GT1GMSCAM4
  misc_feature (216)..(228): Motif name:TATABOX
  misc_feature (279)..(489): 5' untranslated region
  misc_feature (401)..(1000): Ceres Promoter PD3739
tgaaataagttgtacaccaaaaagtttgaatatccggttacaaaaattaggtaggctgaggtttgaaaattgagttccagttgttatgatatttggggacatccattaaaaagtatagtatgaaattttaacaaggtctaattaattttttgaaggaaaaaatatataactaagcataaataaaaatcttatagaaacataaatataagaaaaagattaatatatgatgcttataatgatgagctgtcgtctcatattctcgtttgattcaaaacgatagaaatcgacaaagaaggtgtgaagaagttgggaaaacaaaattaacgcttgaagaatctaaaggtttagcttttttctcaatccgatcattcaccgagaaatattctattttatatatttatgtgaagctcttcaattgaagaaagaagaagaaaagacaatcgtcaaatgcttgactttggtttcagttcttcttcacgacagctcaaggtgatgatcatttttattttactcttctacctaatcatatcactgcgaatcttttccaaagtttcgctctttattctctcaatgtgctttttttctgagttgttgttgaactagggttcttctgggtactagtaactgttttgctgattttctgagctgcttttggctatagaatttcagttttcaaaccaaaccttgtcgatttcaaatcaattctagtcggcagtagatctgatctgtctctattgggctaggttttacagtgtatcaattcaccactagttcaaagttcatcagtgcttacacaagtttacttttttttgtatgtgttcatgatttagctaatgatcaagatacttgagatataataacacaccttatttaatgcaaatgggcctacaaattctactaggaagatcggctctttgatgggatgggacaccaagaaatcaccatgggtttatgatgctatcaattactagtagtacgtgttatcttctgaatatatatc

SEQ ID NO: 911 - DNA, 995 bp, Arabidopsis thaliana
  misc_feature (1)..(995): Ceres Promoter YP2683
  misc_feature (162)..(168): Motif name:AMYBOX2
  misc_feature (271)..(278): Motif name:P1BS
  misc_feature (395)..(399): Motif name:ABRELATED1
  misc_feature (601)..(608): Motif name:CACGCAATGMGH3
  misc_feature (797)..(801): Motif name:ABRELATED1
  misc_feature (891)..(896): Motif name:GT1Consensus
  misc_feature (917)..(923): Motif name:TATABOX4
  misc_feature (956)..(995): 5' untranslated region
caatcggtcgcgaaagacttgatctaggtagagatatacttaattaaaatcgatgaatgaccaagtcaataaatcaagattcaatgttctttcgacgaattctgttcattttgcggttgggatcatgcattcatttaaaataaaccattattgaatacgttatggataatgatagtgattaattatccaatgaggaagagatttggttggattgttttggagagtaataataaaaaataaaggcatgcaatagaaggggcagaccaagtggaatattctgtctaccacaacgaagtttcaatcaaagatatcagaggttaatgtcttccaataagcgaccaaaaatcttgattaataattaattatatcgcccaaagtcactatgaacttgtgaacgtgttattttggagacttttctcacctaaatacatcgagatcgccttgttagttggtacttggtaaacattatgctctaatggctttggttgttattgacgaacatacaatgtaatgaatattttctcaattgagttgtttcatttctaacaaaactagaaactaaaacaaggaaggcgatgtttctcacatgaaatttacatacacgcaatgaaaaccaaaccgactaaattttgtgtttttttcagggtgatttttaagaacattccttaatcaatgggatctaaaaaagtcacttgcctaagaaagtcaccgaaacttcacattcaaagtaactttatcctcttctcagcttttcacattatgaacctcccgtgggaacaaagacatttatacccttacgtgagcttccaagaagaaaccaacaatttttaagatttttccccattacatgtagattagttggcttcaagtttctatggatgttccttctcggaaatccataattctcttcctttatatataaaacttactcacaacacaaaacccatctctcaaaacaatcaatttctctcaaactgttttactttctctttgta

SEQ ID NO: 912 - DNA, 959 bp, Arabidopsis thaliana
  misc_feature (1)..(959): Ceres Promoter YP2816
  misc_feature (180)..(190): Motif name:TL1ATSAR
  misc_feature (538)..(544): Motif name:ANAERO1CONSENSUS
  misc_feature (672)..(679): Motif name:XYLAT
  misc_feature (761)..(767): Motif name:TATABOXOSPAL
  misc_feature (798)..(959): 5' untranslated region
  misc_feature (649)..(959): Ceres Promoter PD3229
  misc_feature (130)..(797): Ceres Promoter PD3243
  misc_feature (448)..(959): Ceres Promoter PD3238
cagtcgtgtttttgccgtttatggttttataattttataaaatgatttatacttgttggtttttatttgtaatttttcctgtaagggggaaatttattttttatacagctaataaatgataaaaactcgaaaattgtgactacagtggaagagtttggtggcagacatttacttgttgtctgaagaagaaattcaatgcaatgactaatctgaaattacactagaatcaaataaagctttacctaatgtaattaaatttctacagagttggtggcttatgaaagataatctaaggagattttgatgctctgtattttcaaattttagatgttggccataaagtaaaatttatttatacttccacactcaatccccattttcagtattacttcaagtcttcgacatactttattctgtaagttttttttttggcatcaaaaagtgtgaaaataaaagtatcattttcttattgaatgatgaatacttatgaaaaagaaaagcaaactttatgacgaataaagcctgaaactgtgttgtaaacaaagtctaaaacgaatgatttttattttctcgtcaagtaatcattttatttttattgatgatttttgatacttcacataatacttttgatattaggccagttaggaataaattttcaaatactttgatctttctttgttgaacttgagcggttcgtacgaacatgctttgatctttttgcatttacttatgaataaagcaaaaacttctaaactgtttctatttaatagattggaactcgagtcggtgtacattgaaaaaataaaccaaaatttaataacagagattatttgccttttaatacatatacacacacgcacatatctacctgcatcttcttcataatcattcctaagaaattctctctctcacacactcaagaacaagacaagagtcaagaaaaatcagccatgcactga

SEQ ID NO: 913 - DNA, 993 bp, Arabidopsis thaliana
  misc_feature (1)..(993): Ceres Promoter YP2832
  misc_feature (175)..(181): Motif name:MYBGAHV
  misc_feature (438)..(446): Motif name:SURE2STPAT21
  misc_feature (480)..(489): Motif name:CARGCW8GAT
  misc_feature (525)..(533): Motif name:SURE2STPAT21
  misc_feature (529)..(538): Motif name:CARGCW8GAT
  misc_feature (763)..(770): Motif name:XYLAT
  misc_feature (816)..(822): Motif name:BOXIIPCCHS
  misc_feature (816)..(823): Motif name:LRENPCABE
  misc_feature (894)..(900): Motif name:TATABOX2
  misc_feature (927)..(993): 5' untranslated region
  misc_feature (595)..(993): Ceres Promoter PD3300
tcaaaaaataaaaatttgagtcgttgctcgtcagattttatgtcactagacagcaacgaaaacaagcacataataatcaaaaccgtagcagaaaatgccaatcaaaggtaaattatggttcatggaggcaatttgcaaacaatgattaggattgtgtcatactgtagaaaaaattaacaaaacaatttttttattattcattgactcgaaggttgaacaagaaggtcgaaaaaataaacatctttacatgggggttcatattatttatgtacaaattgctaccaaggacaaagatcacatgctcatctacaacgataagatcaatgaatttgacagtatattaataaatcatgcatctatacataaataaaaactagtaggaactagtctagtcaaaaagtacagtattatggacaagatatgaaactagctaggataatactaattgctgtagcttaagccacttgaatgttgtccctcattattatgtccaaaaaattcaatgtagacaagaaaaaagaactaatactaatatatgtcttgccacgattgttactttaatctcatttttcaaatattatggtctcatatagccaaatctgtaattcttatattccagtacgtatggagagactcgggagagtcgaaccaagaacatgctcaggccttctgagttgtgacatagatagtacaaccaggcgaccgagacaaacaaaaccatgttatttgtaatgaattataatgatccaatcttgaccacacacaaagaaaagtctgataataatgaaacaaatgagcatgcaaagtatgtgacgacgtggcaaaaaatgagaaggttcaacgaagcaacaaaaagaagtatttcgtcgtctttactcccatcaatatgtgactataaataaaaccatatagttaagtcacacttccatgtcaacgtgcttcaacctatgtaaagctaaaaaaaaaacacatcacacaaaagatctctacact

SEQ ID NO: 914 - DNA, 600 bp, Arabidopsis thaliana
  misc_feature (1)..(600): Ceres Promoter PD2995
  misc_feature (1)..(600): Ceres Promoter PD2263
  misc_feature (365)..(574): Intron
  misc_feature (1)..(10): Motif name:CIACADIANLELHC
  misc_feature (3)..(11): Motif name:EVENINGAT
  misc_feature (21)..(30): Motif name:CARGCW8GAT
  misc_feature (103)..(109): Motif name:ABRERATCAL
  misc_feature (125)..(131): Motif name:RBCSCONSENSUS
  misc_feature (185)..(194): Motif name:CIACADIANLELHC
  misc_feature (249)..(256): Motif name:MYBPLANT
  misc_feature (298)..(301): Transcription Start Site
  misc_feature (272)..(281): Motif name:TATA Box
  misc_feature (304)..(364): 5' untranslated region
  misc_feature (575)..(600): 5' untranslated region
  misc_feature (1)..(365): Ceres Promoter PD3048
  misc_feature (1)..(342): Ceres Promoter PD3676
  misc_feature (1)..(306): Ceres Promoter PD3182
  misc_feature (40)..(600): Ceres Promoter PD2926
  misc_feature (101)..(600): Ceres Promoter PD3345
  misc_feature (176)..(600): Ceres Promoter PD3503
caaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaaaa

SEQ ID NO: 915 - DNA, 900 bp, Arabidopsis thaliana
  misc_feature (1)..(900): Ceres Promoter PD2999
  misc_feature (1)..(900): Ceres Promoter PD2258
  misc_feature (393)..(898): Intron
  misc_feature (106)..(113): Motif name:MYBPLANT
  misc_feature (160)..(900): Ceres Promoter PD3266
  misc_feature (192)..(199): Motif name:XYLAT
  misc_feature (237)..(243): Motif name:ABRERATCAL
  misc_feature (285)..(292): Motif name:UP2ATMSD
  misc_feature (301)..(900): Ceres Promoter PD2929
  misc_feature (305)..(310): Motif name:TATA Box
  misc_feature (339)..(392): 5' untranslated region
  misc_feature (899)..(900): 5' untranslated region
  misc_feature (1)..(339): Ceres Promoter PD3183
  misc_feature (281)..(900): Ceres Promoter PD3240
atagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatagttgatggttgatgtatttttgttgattctgatgtttcgatttttgtttttgttttgacagct

SEQ ID NO: 916 - DNA, 1300 bp, Oryza sativa
  misc_feature (1)..(1300): Ceres Promoter PD3141
  misc_feature (576)..(1289): Intron
  misc_feature (24)..(31): Motif name:MYBPLANT
  misc_feature (122)..(129): Motif name:MYBPLANT
  misc_feature (158)..(165): Motif name:MYBPLANT
  misc_feature (185)..(196): Motif name:ACIIPVPAL2
  misc_feature (188)..(195): Motif name:MYBPLANT
  misc_feature (300)..(306): Motif name:ABRERATCAL
  misc_feature (427)..(434): Motif name:TATABox
  misc_feature (457)..(575): Motif name:5'UTR
  misc_feature (1289)..(1300): Motif name:5'UTR
  misc_feature (151)..(1300): Ceres Promoter PD3584
tagctcacatcatcaaaagcaatggttggtgatgtggagaaaaaattttctatagcaagagaaaaaaaaacacactaaaatccggaaaaacaaaatgagaaagtagtggaggtggagagatgtttggtgaggcgggcgtgggccccacccaacatggggttggtggccactggccacggccacggggggttggtggacgcgggggcgtgggccccacctccccagcgtctgtccgtccggcgggtgagaaaagtttcgggcggggtcagcgacggttcactggctgtgtgtgcggtcctcacgtgctcaccccccggggagaaatacttttcgcacgcgaatcctacccgcacccacggtggggtgggccccactccactcccccgcgcgtcgtctcctacctcccgatccgcacccgacgcgcgctataaataggaggcgcgagcgcattccggaggccacccccgtgcagaatcacacacgccggactctccccttctctctgtctcgctccttcgttcgctcgctttatcccccccgaataaaggcgagaagccgcagcggcggacgaagaaggtgagctctctcgtctcgcctcgtcttcttcttgctcgtgagatcctcactcctctcggggatttttttttctctgttggggtttgggtttgggggtagatctgggttgggcgctcttcgatctgaggagcgcgaggtttggtggattggagatctggggactaggggttagtgattgtttgtttgtttcgtttttcggtcgcggaagtgggaggggaaagcggttggggggatattcttgctttttttgtttaatctttgattgtgcgtgtatggagttctggattagcagaaaaaagggtccgatcttttttggtttatgggggagaacaggctaggctagatctagcgttggtggatccaattttaaattgcaaaattttgtcagtacttagctgtcggctgcagtagatctgaagaatggatctctgttttgtgattaattttctctgttttttttcctttttttgttctgtggtctactacaccaatagagaattcgaatttgctctcctctttctttcagcaagtaggagtaaaatcacttagtactagtatcattttaggtgcaaaaatcgactctttttctcttggatacaccagttcgtcctcatcttggctgcaacgaatgaatggattgatcatctttagaaactgtctgcacaaaatcgagtatttttttttctgatggcttgcaaccgatgcatgcagagggcagatagaa

SEQ ID NO: 917 - DNA, 1000 bp, Arabidopsis thaliana
  misc_feature (1)..(1000): Ceres Promoter YP2680
  misc_feature (359)..(365): Motif name:-300CORE
  misc_feature (466)..(472): Motif name:ANAERO1CONSENSUS
  misc_feature (567)..(574): Motif name:NRRBNEXTA
  misc_feature (709)..(716): Motif name:EMHVCHORD
  misc_feature (709)..(715): Motif name:-300CORE
  misc_feature (842)..(849): Motif name:AUXRETGA1GMGH3
  misc_feature (942)..(950): Motif name:TATABOX4
  misc_feature (975)..(1000): 5' untranslated region
gtctaccgacttttccaccgtccatccttcgacgatggttctttctaaatgaccttctcagttttttcctgtcatgcgtattattattattagttaataaggctccactactactcggaaagtccgagtacaaataatatgacaataatgtcaaacttattcttagtattggtttaaaagaaggattcaacaagagtacttaatcacgtctcataattaccactttcatccaaacatggtcattactatatgacatgatcgtgttacattaatttggaaagtagtatatgtctttttcctaaaagtttatgtttagatttttgatcactaagaatataatgtcatatatattattaacctttacacctaaatgttatattaattacttgaatgataaaacggaaaatatcgaaagtttaggctaggtctctctagcatctctagtgtatttatttagcaatcccaaaacaaaattgtgttttctacaattttagtattagattaccaaaattgttgtatatagtctggtgattccgttttgatggtcgagatcgaaagaagcaagcatccactatgtggtcgtcacatgcgaatatttctaagtatacaaccatctatcgaaagtttcgaaacaacccaaatataatagtaataaattctgagaattctcctattttttattgatatgaaaaaagcagtaaaatattatgtaaagtagagaggaaccaaaattaaaacgtgcagatttattaaaagaataaagtgggatccaaaaagtcagcgtgaaacatgtgatacgatataacgacacggtcctatgactaagtccactccaatccagtgacgtaaacagcaccatcacccatagcttcctgtgacgcacatccttacgtaaccatcgttgacgctagactttcctctctgatctctctttcttcatgtatatataacaaaaccttcctttcctaattggtatctatctttaaaaacatacttgaaa

SEQ ID NO: 918 - DNA, 1000 bp, Arabidopsis thaliana
  misc_feature (1)..(1000): Ceres Promoter PD3147
  misc_feature (1)..(1000): Ceres Promoter YP2663
  misc_feature (203)..(212): Motif name:MARTBOX
  misc_feature (347)..(355): Motif name:TELOBOXATEEF1AA1
  misc_feature (392)..(397): Motif name:IBOXCORENT
  misc_feature (576)..(583): Motif name:INRNTPSADB
  misc_feature (613)..(622): Motif name:MARTBOX
  misc_feature (792)..(799): Motif name:E2FCONSENSUS
  misc_feature (804)..(809): Motif name:IBOXCORENT
  misc_feature (823)..(828): Motif name:IBOXCORENT
  misc_feature (698)..(704): Motif name:SORLREP3AT
  misc_feature (941)..(1000): 5' untranslated region
  misc_feature (501)..(1000): Ceres Promoter PD3721
agtaatggtttacacattgattattctataagaaacatctagaaaagaaaaaaaaggaaaaaaaacatctagaaatatatcagaacttctttcacaaaagaataatatatatcagaactgcgtgttattaattcaacgagttcaaacttcaaagtatgatgtggtaacacaaccaaattctcctctcggatataattagaccaaaaaaaaaaagacgaaatatttttgctataaacaatatatatatgggtaaatgtgaagaaatttgtttcttctgccaggaaatagacagttaatacattgaaaaaatggtaaaactttaaagaaaagcatatcttaagagatgaaaccctaattaaggtgttgagacttcagagacagatcaagagatcttatcagaagatatctgtgaagcatttcaaacaaacattacaaaaaatgtagcctccttccggcggaatggtagaaggagttgtaattctgctaatgtttattttggtcatatatagatttaattctttgatattgcaaactcatgatcccattttcttattatgtggttaaccaataaaagactcaattttgcagtcttactaatcaggactatttgccaaaaaaaaaactaatcaggactaaaaaactacatctctttttttttttgctacatatatatatatatatgattattttcagtgtatatataatatgtatagatattaaaaataaataaaagataagtcgtgtgtagtccacatatcttgaacatcaaaatgacaaaactattaaaatccgcggcaaaatctcttatccagtgacatgttacttatcaaccaatcacaacacgccacctcatcaccccaagaccacttctcttatcttcctctccctccactaatcccctcaagaatctaaagctcctcccataagtcttctctccacacttcacccaaaactccagaaccctagaattcgaaatctccaaagaacccgacaaagcgcc

SEQ ID NO: 919 - DNA, 1000 bp, Arabidopsis thaliana
  misc_feature (1)..(1000): Ceres Promoter PT0822
  misc_feature (601)..(1000): Ceres Promoter PD3389
  misc_feature (645)..(649): Motif name:ROOTMOTIFTAPOX1
  misc_feature (654)..(661): Motif name:E2FCONSENSUS
  misc_feature (657)..(663): Motif name:LEAFYATAG
  misc_feature (720)..(729): Motif name:CARGCW8GAT
  misc_feature (817)..(821): Motif name:ROOTMOTIFTAPOX1
  misc_feature (823)..(840): Motif name:AGL2ATCONSENSUS
  misc_feature (827)..(836): Motif name:CARGATCONSENSUS
  misc_feature (785)..(790): Motif name:TATABOX5
  misc_feature (848)..(1000): 5' untranslated region
  misc_feature (601)..(1000): Ceres Promoter PD3389
ccaccaacatacattagaatctaatgtaattacatcatcaatcatagacctaatgaatatttaataccacacagtttaaacattgctattaaagtttgaaaagattatactttagtaaaataatgttttcaaacttgtattcaattatactacgtaagcagtgatccaattattacgaacataatacttttccaaatcaaaattttgtttttgttcaccttaccatcagtttcataatagaaatattatatatatacaacacaaacaaatgaatgagaaatgtttttctattattatgacttttatttaagattcaaaagaacgaagaagagttatatatatgcttgtttgtttcaggacaaatacaataaataagtggataagaaaaccacaaaccttgaactagcctgaaatgtgtgaaccaagctatacaaactgtacgtgattctgcatcgtggaagtcacaaacagacttctgacttctgctaaagataaaactcactgtttgcaagcaatttagtataaatatgaagcattgacctaccaagatcgacacaatcacacagtttcttcttaattaaacctagctatttttgtctttagcagaagtcagaaagctagttttgtatttttcttatttcttaaatatatggcggccaatgttatgagacggtttatgatttaaagatacacaatggacccacgacgttgccataatacaattattaggctgttaattaacgtgatcgttacgtttgctacaaactagctagttgtgtcttctttattttagtagataagtataagagtctaaaaatattacaacccaataatggttacattcatggtcgacttagaagatgaaagttgatttcttaaaaaaaaaacacgcacaataaataaaccaccaattcacaaatacaagaaatttaataacctcgagcagttaccctatttaaatcccctctagccttgttttccttctcacacctatgaagca

What is claimed is:

1. A vector construct comprising:
   a) a first nucleic acid comprising
      (i) the nucleic acid sequence of SEQ ID NO: 148 wherein the nucleic acid sequence of SEQ ID NO: 148 has a promotor activity,
      (ii) a nucleic acid sequence having at least 96 percent sequence identity to SEQ ID NO: 148 and having the promoter activity of SEQ ID NO:148, or
      (iii) a fragment of at least 500 consecutive nucleotides of the nucleic acid sequence of SEQ ID NO:148 having the promoter activity of SEQ ID NO:148; and
   b) a second nucleic acid that is transcribable;
   wherein said first and second nucleic acid molecules are heterologous to each other and are operably linked together.

2. The vector construct according to claim 1, wherein said first nucleic acid comprises a nucleic acid sequence having at least 97 percent sequence identity to SEQ ID NO:148.

3. The vector construct according to claim 1, wherein said first nucleic acid comprises the nucleic acid sequence of SEQ ID NO: 148.

4. A host cell comprising the vector construct according to claim 1.

5. The host cell according to claim 4, wherein said first nucleic acid comprises a nucleic acid sequence having at least 97 percent sequence identity to SEQ ID NO: 148.

6. The host cell according to claim 4, wherein said first nucleic acid comprises the nucleic acid sequence of SEQ ID NO:148.

7. A plant cell comprising the vector construct of claim 1.

8. A method of modulating transcription by combining, in an environment suitable for transcription:
 a) a first nucleic acid comprising
  (i) the nucleic acid sequence of SEQ ID NO:148 wherein the nucleic acid sequence of SEQ ID NO:148 has a promotor activity,
  (ii) a nucleic acid sequence having at least 96 percent sequence identity to SEQ ID NO:148 and having the promoter activity of SEQ ID NO:148, or
  (iii) a fragment of at least 500 consecutive nucleotides of the nucleic acid sequence of SEQ ID NO:148 having the promoter activity of SEQ ID NO:148; and
 b) a second nucleic acid to be transcribed; wherein the first and second nucleic acid molecules are heterologous to each other and operably linked together.

9. The method of claim 8, wherein said first nucleic acid comprises a nucleic acid sequence having at least 97 percent sequence identity to SEQ ID NO:148.

10. The method of claim 8, wherein said first nucleic acid comprises a nucleic acid sequence having at least 98 percent sequence identity to SEQ ID NO:148.

11. The method of claim 8, wherein said first nucleic acid comprises the nucleic acid sequence of SEQ ID NO:148.

12. A plant comprising the vector construct according to claim 1.

* * * * *